United States Patent 7,745,391 (HUMAN THROMBOSPONDIN POLYPEPTIDE) - sequence listing, part 162

SEQ ID NO: 418850 - DNA, 3104 bp, Homo sapiens
catgctggccaggctggtcttgaacccctgacctcagttgatccgcccgccttggcctcccaaagtgctgggattacaggcgtgagccaccgtgcccggccgccatcacttatttatattatgtgttacctataggacttatctaagaccataatcactgccgcgtgtgctaagtcccgcgcgcgtgcactcaggcccctctggatagacactggggacccctgaccacttatgtcagggaaaacgccaccaagcgctccggaacctcagggcaggacccgccgcagcagcagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggttcccatggtggccggctcccctctcggggcaacccagacgtgcaacaaagtgcgatgcgtcgtcccccagactacagtaatactcaacaatgatcggcagaacgccattgtagccaagatggaagaccccttgagcaacagggcaccggattccctggaaaatgtcattagcaacgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctaacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgaggagcccgtgttctggtactacgtgaaggaggtcctcaacaagcacgagctgcaagcgcttctactccctgcgccacatcgcctcagacgtgggccggggccgcacctggctgcgctgtgccctcaacgaacactccctggagcgctacctgcacatgctcctggccgaccgctgcaggctcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtgggatgaaaacgaagatgacgtgtatggaaactcatcaggacggaagcacaggggccactcagagtcgcccgagaaaaacggagcacactctgtcacccaggctggagtgcaatggcacgatctcagctcactacaacctctgcctcccgggttcaagtgattctactgcctcagcctcccgtgtagctgggattacaggcgcgcaccaacacacccgactaatttttgtatttttagtaaagacagggtttcaccatgttggccaggctggtcttgcactcctgacctcacgtgatctgccccaccttggcctcccaaagtgctgggattacaggtgtgaaccactgcgcccagccccaagtggctttttcaattacatgagccaacatattctcacaagtccattcgagtttggtgtctgttacttgcaaataagggagttctgattggttcccagtgaaacctcatctgtaagacctctgagccaccagtatccacggggcttgtcctataacagctcctgtgcaatccagtaaccttgaacactggaagccactgagcccttctgtgagtagatgcacacctctgaggctaagattactggtgtactcattgggaccagtttggtctcagtgactgaaaactcaacccaaacttgttcatttggaaaggaaaagtcaaccaggcacagtggctcatgcctgtagttccagcactttgggaggctgaggtggacagatcgcttgagcccaggggttcaagaccaacctgggcaacatagcaaaaccctgcctctacaaaaaaaaa

SEQ ID NO: 418851 - DNA, 3115 bp, Homo sapiens
gcagagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggttcccatggtggccggctcccctctcggggcaacccagacgtgcaacaaagtgcgatgccttccacaacaaagcggaccttagatatcccttgtgaccagaaagtgctaaggcttaaaaacgcatgatggaaaactgtggcgtcgtcccccagactacagtaatactcaacaatgatcggcagaacgccattgtagccaagatggaagaccccttgagcaacagggcaccggattccctggaaaatgtcattagcaacgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctaacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgaggagcccgtgttctggtactacgtgaaggaggtcctcaacaagcacgagctgcaagcgcttctactccctgcgccacatcgcctcagacgtgggccggggccgcacctggctgcgctgtgccctcaacgaacactccctggagcgctacctgcacatgctcctggccgaccgctgcaggctcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtgggatgaaaacgaagatgacgtgtatggaaactcatcaggacggaagcacaggggccactcagagtcgcccgagaaaaacggagcacactctgtcacccaggctggagtgcaatggcacgatctcagctcactacaacctctgcctcccgggttcaagtgattctactgcctcagcctcccgtgtagctgggattacaggcgcgcaccaacacacccgactaatttttgtatttttagtaaagacagggtttcaccatgttggccaggctggtcttgcactcctgacctcacgtgatctgccccaccttggcctcccaaagtgctgggattacaggtgtgaaccactgcgcccagccccaagtggctttttcaattacatgagccaacatattctcacaagtccattcgagtttggtgtctgttacttgcaaataagggagttctgattggttcccagtgaaacctcatctgtaagacctctgagccaccagtatccacggggcttgtcctataacagctcctgtgcaatccagtaaccttgaacactggaagccactgagcccttctgtgagtagatgcacacctctgaggctaagattactggtgtactcattgggaccagtttggtctcagtgactgaaaactcaacccaaacttgttcatttggaaaggaaaagtcaaccaggcacagtggctcatgcctgtagttccagcactttgggaggctgaggtggacagatcgcttgagcccaggggttcaagaccaacctgggcaacatagcaaaaccctgcctctacaaaaaaaaa

SEQ ID NO: 418852 - DNA, 656 bp, Homo sapiens
  misc_feature (608)..(608): n is a, c, g, or t
gcagagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccaggtacagagctgtgggacagtagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggttcccatggtggccggctcccctctcggggcaacccagacgtgcaacaaagtgcgatggcgctaccgttttggaatgataccaacacttacgtggttacgaacgttagatctgtcccataggaatgagtngggatggagtgactgaaaatgtcaagccagttctcatgcaagtgtgcc

SEQ ID NO: 418853 - DNA, 1328 bp, Homo sapiens
agtaaaatcaaattctttaaactttcttctattccaatattccttatcccaagttaaggagcgttaccaactatattttgataataaaaatgtaaactgagttgtggcaatgattaatatcaattagagaatattttcacaataaatttgtgtcattgagattgacattgcctggactattccacatattttgttttggaatgcagttaagattgggacttatacactgtagggtagaatgagtaacagtacccccggttcccttgtattgacaagtccacgacctggttcttgctgatattttcaatttattactgcagtagataattgctctgaaagtgcaacactaaatcactcttgtcatagcctctgctccgtttccactggcaaatacttggaaattcattcttcgagcattgtggaccacaagcttctctctgggtggaaaattattgccactgccagtatcatagggaacacacacacacacacacacacacacgaacagaaggattcaaaaagcagacactggagaggagtaggggccaatttcaaacagaaaacccagtaaagggctggagaggacacctcccttttggcccctgtactccccgttctttcagaaaaaaagcatccccaaaacagtggtaattagagggtgttcaggaatggaaaagtaggaagagtgtagtacaaatacaataaggaaatgcctgttactctcatatgatttctctgagaccaggtggccaaggatcccctagtcttccacatatgttttaaagagaggccttaatttaaggtactgcagtctttgctcacaagagccaagtaagacggtgctacttggaggttgctataggactctgacgctatttatttgaatcctaggtgctcttgtgacttctctgacttcagtccttctggagtcagatcacccagcttctctgatgagtgactggtcatttttaaagcatgcctgcagcagtcttcaagaggtttctgcctgggcatcacgatcagcacacatttgctcatacacataccaggtgatgaggactcaaccactgcagacaggcagagccatgcaaataaagccatccagcaaggtcaccttttcctcagatgccccagtttcaggatgatagaatttgcatattaagtgttaataggcctggcaataaccagcttttgcttcccttcctcaatgagggacatgccagaaacagacttgcacacaggctctgctcatatgggaaacaggcctgacacacagggtctgctcatatgggaaaatgatttcagtcacagtccttagctccaaattc

SEQ ID NO: 418854 - DNA, 953 bp, Homo sapiens
ctggtgagctttacatgtcctcatttttgagagagggtaacagcttccaattaattacatctccttgggcacaaagaattgcttttgtggtgggacagaagttcaaaggtgtagaaggctgtgtgcagatgctgagtggctaacaggggctgtgccagttaggaagctcgtctctcagttccacacccgctctttttagctctgcttttgtgataccagcgacagaactctgcaaacatctctgcttcgcagctggcatcctgttggatttttccagtagagggaagcttccatgctgcaggaagaaggggcgtgctccttcccgttcctgtcagcactgctgcagcagtttgctctcacagctgcatgtgatcccagctgccatttctgacctgctcagaaccagcttcatgatgggctcaaagacccaggaccaggtgctcttgtgacttctctgacttcagtccttctggagtcagatcacccagcttctctgatgagtgactggtcatttttaaagcatgcctgcagcagtcttcaagaggtttctgcctgggcatcacgatcagcacacatttgctcatacacataccagctctggcatgtacacgtggccacggtacccttcgtacaacacgggaagagaacaacaggacgcccaagaggcatctggacagcacacagcaaacagaaaggctgaacgcccccccatggaaccccattaaaaaacaatgtttgtctattacaaagtcacgttttccgtttttccgctttataaagtcagcgatgctggagggtgtctagcggaatccgtcctccaggaatgagtgcaaaaggagagcgcacggctcagggacgtcccttcagtgagcaatggaaggactggctggaggcctcccatccatttcggacaaacacacacatacagaaaaggattattgccagcttgtgta

SEQ ID NO: 418855 - DNA, 795 bp, Homo sapiens
ctggtgagctttacatgtcctcatttttgagagagggtaacagcttccaattaattacatctccttgggcacaaagaattgcttttgtggtgggacagaagttcaaaggtgtagaaggctgtgtgcagatgctgagtggctaacaggggctgtgccagttaggaagctcgtctctcagttccacacccgctctttttagctctgcttttgtgataccagcgacagaactctgcaaacatctctgcttcgcagctggcatcctgttggatttttccagtagagggaagcttccatgctgcaggaagaaggggcgtgctccttcccgttcctgtcagcactgctgcagcagtttgctctcacagctgcatgtgatcccagctgccatttctgacctgctcagaaccagcttcatgatgggctcaaagacccaggaccagctctggcatgtacacgtggccacggtacccttcgtacaacacgggaagagaacaacaggacgcccaagaggcatctggacagcacacagcaaacagaaaggctgaacgcccccccatggaaccccattaaaaaacaatgtttgtctattacaaagtcacgttttccgtttttccgctttataaagtcagcgatgctggagggtgtctagcggaatccgtcctccaggaatgagtgcaaaaggagagcgcacggctcagggacgtcccttcagtgagcaatggaaggactggctggaggcctcccatccatttcggacaaacacacacatacagaaaaggattattgccagcttgtgta

SEQ ID NO: 418856 - DNA, 742 bp, Homo sapiens
agtaaaatcaaattctttaaactttcttctattccaatattccttatcccaagttaaggagcgttaccaactatattttgataataaaaatgtaaactgagttgtggcaatgattaatatcaattagagaatattttcacaataaatttgtgtcattgagattgacattgcctggactattccacatattttgttttggaatgcagttaagattgggacttatacactgtagggtagaatgagtaacagtacccccggttcccttgtattgacaagtccacgacctggttcttgctgatattttcaatttattactgcagtagataattgctctgaaagtgcaacactaaatcactcttgtcatagcctctgctccgtttccactggcaaatacttggaaattcattcttcgagcattgtggaccacaagcttctctctgggtggaaaattattgccactgccagtatcatagggaacacaaacacacctagccaggaggcctgaccactcactcactcctaagcacactctacacatacacactgactttcccacacacacaacagtcaggtagatgcccaaaggagggcaaatccaaatatctgctctctttggaattttcacggcaaatctgaatttaggcaaaagtgaagacctccctggggtcttcaaagacagcctttgctctccatgtagccaatggtgctcttatatttgccgagcccttcacaactgtctgga

SEQ ID NO: 418857 - DNA, 667 bp, Homo sapiens
agtaaaatcaaattctttaaactttcttctattccaatattccttatcccaagttaaggagcgttaccaactatattttgataataaaaatgtaaactgagttgtggcaatgattaatatcaattagagaatattttcacaataaatttgtgtcattgagattgacattgcctggactattccacatattttgttttggaatgcagttaagattgggacttatacactgtagggtagaatgagtaacagtacccccggttcccttgtattgacaagtccacgacctggttcttgctgatattttcaatttattactgcagtagataattgctctgaaagtgcaacactaaatcactcttgtcatagcctctgctccgtttccactggcaaatacttggaaattcattcttcgagcattgtggaccacaagcttctctctgggtggaaaattattgccactgccagtatcatagggaacacaacacacaacagtcaggtagatgcccaaaggagggcaaatccaaatatctgctctctttggaattttcacggcaaatctgaatttaggcaaaagtgaagacctccctggggtcttcaaagacagcctttgctctccatgtagccaatggtgctcttatatttgccgagcccttcacaactgtctgga

SEQ ID NO: 418858 - DNA, 1402 bp, Homo sapiens
agtaaaatcaaattctttaaactttcttctattccaatattccttatcccaagttaaggagcgttaccaactatattttgataataaaaatgtaaactgagttgtggcaatgattaatatcaattagagaatattttcacaataaatttgtgtcattgagattgacattgcctggactattccacatattttgttttggaatgcagttaagattgggacttatacactgtagggtagaatgagtaacagtacccccggttcccttgtattgacaagtccacgacctggttcttgctgatattttcaatttattactgcagtagataattgctctgaaagtgcaacactaaatcactcttgtcatagcctctgctccgtttccactggcaaatacttggaaattcattcttcgagcattgtggaccacaagcttctctctgggtggaaaattattgccactgccagtatcatagggaacacacacacacacacacacacacacgaacagaaggattcaaaaagcagacactggagaggagtaggggccaatttcaaacagaaaacccagtaaagggctggagaggagtaggggccaatttcaaacagaaaacccagcaaaggagttagaggagaacagctccaactgtgcaaagtggagaccgactctccactctccagtggcaacctcacattctggtactgtgcaaagcggagaccgactcttcactctcctcacattctggttacgttggccctggtagacctttatccctttgcctctgtaacggtgataccataatcataaccgtgccacatctcagcatatcagaggcccatggagtaaaaatagatgaaaagacctctcaagctagtttggaaaaatagagggtttagataaactgactatttaatctcctacttaaacctgttaggcagaatatctgggagaacactgggcgtaagatgctgcctaacaggcataaccccttgctctaaccagcctagggccagtatgtttttgatggaaaagacaactgtcaaatactacaacgacaaaaaggaagggaaaacatgagcagctctagaaaacgtaagattcaaaactctgaacaacaacaacaacaacaacaaaactatggacaacacacctagccaggaggcctgaccactcactcactcctaagcacactctacacatacacactgactttcccacacacacaacagtcaggtagatgcccaaaggagggcaaatccaaatatctgctctctttggaattttcacggcaaatctgaatttaggcaaaagtgaagacctccctggggtcttcaaagacagcctttgctctccatgtagccaatggtgctcttatatttgccgagcccttcacaactgtctgga

SEQ ID NO: 418859 - DNA, 1290 bp, Homo sapiens
agtaaaatcaaattctttaaactttcttctattccaatattccttatcccaagttaaggagcgttaccaactatattttgataataaaaatgtaaactgagttgtggcaatgattaatatcaattagagaatattttcacaataaatttgtgtcattgagattgacattgcctggactattccacatattttgttttggaatgcagttaagattgggacttatacactgtagggtagaatgagtaacagtacccccggttcccttgtattgacaagtccacgacctggttcttgctgatattttcaatttattactgcagtagataattgctctgaaagtgcaacactaaatcactcttgtcatagcctctgctccgtttccactggcaaatacttggaaattcattcttcgagcattgtggaccacaagcttctctctgggtggaaaattattgccactgccagtatcatagggaacacacacacacacacacacacacacgaacagaaggattcaaaaagcagacactggagaggagtaggggccaatttcaaacagaaaacccagtaaagggctggagaggagtaggggccaatttcaaacagaaaacccagcaaaggagttagaggagaacagctccaactgtgcaaagtggagaccgactctccactctccagtggcaacctcacattctggtactgtgcaaagcggagaccgactcttcactctcctcacattctggttacgttggccttaatttaaggtactgcagtctttgctcacaagagccaagtaagacggtgctacttggaggttgctataggactctgacgctatttatttgaatcctaggtgctcttgtgacttctctgacttcagtccttctggagtcagatcacccagcttctctgatgagtgactggtcatttttaaagcatgcctgcagcagtcttcaagaggtttctgcctgggcatcacgatcagcacacatttgctcatacacataccaggtgatgaggactcaaccactgcagacaggcagagccatgcaaataaagccatccagcaaggtcaccttttcctcagatgccccagtttcaggatgatagaatttgcatattaagtgttaataggcctggcaataaccagcttttgcttcccttcctcaatgagggacatgccagaaacagacttgcacacaggctctgctcatatgggaaacaggcctgacacacagggtctgctcatatgggaaaatgatttcagtcacagtccttagctccaaattc

SEQ ID NO: 418860 - DNA, 1449 bp, Homo sapiens
agtaaaatcaaattctttaaactttcttctattccaatattccttatcccaagttaaggagcgttaccaactatattttgataataaaaatgtaaactgagttgtggcaatgattaatatcaattagagaatattttcacaataaatttgtgtcattgagattgacattgcctggactattccacatattttgttttggaatgcagttaagattgggacttatacactgtagggtagaatgagtaacagtacccccggttcccttgtattgacaagtccacgacctggttcttgctgatattttcaatttattactgcagtagataattgctctgaaagtgcaacactaaatcactcttgtcatagcctctgctccgtttccactggcaaatacttggaaattcattcttcgagcattgtggaccacaagcttctctctgggtggaaaattattgccactgccagtatcatagggaacacacacacacacacacacacacacgaacagaaggattcaaaaagcagacactggagaggagtggggccaatttcaaacagaaaacccaataaagggctggagaggagtaaggggccaatttcaaacagaaaacccagtaaagggctggagaggagtaggggccaatttcaaacagaaaacccagcaaaggagttagaggagaacagctccaactgtgcaaagtggagaccgactctccactctccagtggcaacctcacattctggtactgtgcaaagcggagaccgactcttcactctcctcacattctggttacgttggccctggtagacctttatccctttgcctctgtaacggtgataccataatcataaccgtgccacatctcagcatatcagaggcccatggagtaaaaatagatgaaaagacctctcaagctagtttggaaaaatagagggtttagataaactgactatttaatctcctacttaaacctgttaggcagaatatctgggagaacactgggcgtaagatgctgcctaacaggcataaccccttgctctaaccagcctagggccagtatgtttttgatggaaaagacaactgtcaaatactacaacgacaaaaaggaagggaaaacatgagcagctctagaaaacgtaagattcaaaactctgaacaacaacaacaacaacaacaaaactatggacaacacacctagccaggaggcctgaccactcactcactcctaagcacactctacacatacacactgactttcccacacacacaacagtcaggtagatgcccaaaggagggcaaatccaaatatctgctctctttggaattttcacggcaaatctgaatttaggcaaaagtgaagacctccctggggtcttcaaagacagcctttgctctccatgtagccaatggtgctcttatatttgccgagcccttcacaactgtctgga

SEQ ID NO: 418861 - DNA, 1357 bp, Homo sapiens
agtaaaatcaaattctttaaactttcttctattccaatattccttatcccaagttaaggagcgttaccaactatattttgataataaaaatgtaaactgagttgtggcaatgattaatatcaattagagaatattttcacaataaatttgtgtcattgagattgacattgcctggactattccacatattttgttttggaatgcagttaagattgggacttatacactgtagggtagaatgagtaacagtacccccggttcccttgtattgacaagtccacgacctggttcttgctgatattttcaatttattactgcagtagataattgctctgaaagtgcaacactaaatcactcttgtcatagcctctgctccgtttccactggcaaatacttggaaattcattcttcgagcattgtggaccacaagcttctctctgggtggaaaattattgccactgccagtatcatagggaacacacacacacacacacacacacacgaacagaaggattcaaaaagcagacactggagaggagtgtaggggccaatttcaaacagaaaacccagcaaaggagttagaggagaacagctccaactgtgcaaagtggagaccgactctccactctccagtggcaacctcacattctggtactgtgcaaagcggagaccgactcttcactctcctcacattctggttacgttggccctggtagacctttatccctttgcctctgtaacggtgataccataatcataaccgtgccacatctcagcatatcagaggcccatggagtaaaaatagatgaaaagacctctcaagctagtttggaaaaatagagggtttagataaactgactatttaatctcctacttaaacctgttaggcagaatatctgggagaacactgggcgtaagatgctgcctaacaggcataaccccttgctctaaccagcctagggccagtatgtttttgatggaaaagacaactgtcaaatactacaacgacaaaaaggaagggaaaacatgagcagctctagaaaacgtaagattcaaaactctgaacaacaacaacaacaacaacaaaactatggacaacacacctagccaggaggcctgaccactcactcactcctaagcacactctacacatacacactgactttcccacacacacaacagtcaggtagatgcccaaaggagggcaaatccaaatatctgctctctttggaattttcacggcaaatctgaatttaggcaaaagtgaagacctccctggggtcttcaaagacagcctttgctctccatgtagccaatggtgctcttatatttgccgagcccttcacaactgtctgga

SEQ ID NO: 418862 - DNA, 1272 bp, Homo sapiens
agtaaaatcaaattctttaaactttcttctattccaatattccttatcccaagttaaggagcgttaccaactatattttgataataaaaatgtaaactgagttgtggcaatgattaatatcaattagagaatattttcacaataaatttgtgtcattgagattgacattgcctggactattccacatattttgttttggaatgcagttaagattgggacttatacactgtagggtagaatgagtaacagtacccccggttcccttgtattgacaagtccacgacctggttcttgctgatattttcaatttattactgcagtagataattgctctgaaagtgcaacactaaatcactcttgtcatagcctctgctccgtttccactggcaaatacttggaaattcattcttcgagcattgtggaccacaagcttctctctgggtggaaaattattgccactgccagtatcatagggaacacacacacacacacacacacacacgaacagaaggattcaaaaagcagacactggagaggagtaggggccaatttcaaacagaaaacccagtaaagggctggagaggacacctcccttttggcccctgtactccccgttctttcagaaaaaaagcatccccaaaacagtggtaattagagggtgttcaggaatggaaaagtaggaagagtgtagtacaaatacaataaggaaatgcctgttactctcatatgatttctctgagaccaggtggccaaggatcccctagtcttccacatatgttttaaagagaggccttaatttaaggtactgcagtctttgctcacaagagccaagtaagacggtgctacttggaggttgctataggactctgacgctatttatttgaatcctaggtgctcttgtgacttctctgacttcagtccttctggagtcagatcacccagcttctctgatgagtgactggtcatttttaaagcatgcctgcagcagtcttcaagaggtttctgcctgggcatcacgatcagcacacatttgctcatacacataccaggtgatgaggactcaaccactgcagacaggcagagccatgcaaataaagccatccagcaaggtcaccttttcctcagatgccccagtttcaggatgatagaatttgcatattaagtgttaataggcctggcaataaccagcttttgcttcccttcctcaatgagggacatgccagaaacagaccggacgcgtgggtcgacccaccggccgtccgcgacgcgtgg

SEQ ID NO: 418863 - DNA, 1953 bp, Homo sapiens
aaggccacatagagtgtttgcagtggttaattaaaatgggagcagacagtaatattaccaacaaagcaggggagagacccagtgatgtggcaaagaggtttgcccatttggcagcagtgaagctgttagaggagctacagaaatatgatatagatgacgaaaatgaaattgatgaaaatgatgtgaaatattttataagacatggtgttgagggaagcactgatgccaaggatgatttatgtctgagtgacttggataaaacagatgccagaatgagagcttacaagaaaattgtagaattgagacacctcctggaaattgccgagagcaactataaacacttgggaggcataacagaagaagatttaaagcagaagaaagaacagcttgagtctgaaaagaccatcaaagaactgcagggccagctggagtatgaacgactacgtagagaaaaattagaatgtcagcttgatgaatatcgagcagaagttgatcaactcagggaaacactggaaaaaattcaagtcccaaactttgtggctatggaagacagcgcttcttgtgagtcaaacaaagagaagaggcgagtaaaaaaaaaggtttcttctggaggggtgtttgtgagaagatttacaattgggcaagtcactttacctagggcagagtggataaggggatgaagagtgacgacagtgttatgctactggagcttccttcacatggaggaaagacgcattccctcttaatattttagaatattttaaatcttaacaaaccaataatttacttgtttatgtctctctccttaagattgtcaattcaatgagaatgaaaccatgttcatctctgtgcacacagggactagcatgctgtttggcatatagcaggcagtcatattggttaactgaacaaatgcagtatactttgttacagtggactttaatatatatggtaacttattaattgactcagtgaaaattaatctataatatactaagaactctcttaggcaatagagataaaaatgaatcagaatgtaacaggataatgtcaaggtttttcttttgaaaacaaaccagcagttagatttttgaggaaaatatagttggaaagcctgactctcactcactggaccatatggaccaatctcttgactgctctatactgcagattccctgtttatagctaaacaaatgacaaggctattttgaataatgattgtcaaacttttatagctattaccaaggcattatgaactcaaaatgtttactttctggtcttgtcttcttgatctgggtaagactgaagaactaagatgaaaaggatattttaaaatttctttgaaattacatatgatttactaatagatattactttgtaagaaaaaatatatctaataacaaaacaaaatacgaatttaaattttcctatgagtttcttgagagtaggtactagatatcaatgtttgctgaattgaagtcattaagaaaagctttgttttatgtaataaatttaagatgggttaacttaaactacattaagaagcagggataaactggtttttgagtatcaaatatttaaaaaatacatgtaataatcagagctcaatatttagcaactctacagatttcatattaagtgttgtaatttgcactaaagcacacatttatttatttaggtaatggagtcttgctctgtcacccaggctggagtgcagtggtgctatctcggctcactgcaagattctcctgcctcagcctcccgagtagctggaattacaggcatgtgccaccatgcctggctaatttttgtatttttagcagagacggggtttcaccatgttggccaggctggtctagaactcctgacctcaagtgatccacccgcctcagcctcccaaagtgctgagattacaggtgtgagccaccgcgcctggcctatcattttaaaatt

SEQ ID NO: 418864 - DNA, 687 bp, Homo sapiens
gcctgtttatcgatgtagaatttcaacagtatttatcgaagtactgggtacaggccattttttgttttgttgttgttgtttttgaactaccaccacagtcatgcaaatgaatatgagctgttgaattaattaccctatcttctacatctcttctacttcccatcacgctggcctacaggagtttccggcatgtgctgtaggccagcgacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaaccgctggcctacagcacatgccggtgtgctgtaggccagc

SEQ ID NO: 418865 - DNA, 5703 bp, Homo sapiens
gtgggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagagaacttgcgcctgtcaggggctggatccagaaacctgtggtgcctccttctcttttggttgttcatggagcatgtactacaatggatgtaagtttgccagaagcaagatcccaaggaagtttaagctgcttggggatgacccaaaagaggaagagaaactggagtctcatttgcaaaacctgtccactcttatggcaccaacatataagaaacttgcacctgatgcatataataatcagattgaatatgaacacagagcaccagagtgccgtctgggtctgaaggaaggccgtccattctcaggggtcactgcatgtttggacttctgtgctcatgcccacagagacttgcacaacatgcagaatggcagcacattggtatgcactctcactagagaagacaatcgagaatttggaggaaaacctgaggatgagcagcttcacgttctgcctttatacaaagtctctgacgtggatgagtttgggagtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcagaacttttgcgactttcaggaccagtcatgcagcagtcccagcagccccagcctctacagaagcagccaccacagccccagcagcagcagagaccccagcagcagcagccacatcaccctcagacagagtctgtcaactcttattctgcttctggatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctggatcctgacattgggggagtggccgtggctccaactcatgggtcaattctcattgagtgtgcaaagcgtgagctgcatgccacaacccctttaaagaatcccaataggaatcaccccaccaggatctccctcgtcttttaccagcataagagcatgaatgagccaaaacatggcttggctctttgggaagccaaaatggctgaaaaagcccgtgagagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatgatatcacccccttttgttggttacctcacttgaaaagaccacaaccaacctgtcagtagtatagttctcatgacgtgggcagtggggaaaggtcacagtattcatgacaaatgtggtgggaaaaacctcagctcaccagcaacaaaagaggttatcttaccatagcacttaattttcactggctcccaagtggtcacagatggcatctaggaaaagaccaaagcattctatgcaaaaagaaggtggggaagaaagtgttccgcaatttacatttttaaacactggttctattattggacgagatgatatgtaaatgtgatcccccccccccgcttacaactctacacatctgtgaccacttttaataatatcaagtttgcatagtcatggaacacaaatcaaacaagtactgtagtattacagtgacaggaatcttaaaataccatctggtgctgaatatatgatgtactgaaatactggaattatggctttttgaaatgcagtttttactgtaatcttaacttttatttatcaaaatagctacaggaaacatgaatagcaggaaaacactgaatttgtttggatgttctaagaaatggtgctaagaaaatggtgtctttaatagctaaaaatttaatgcctttatatcatcaagatgctatcagtgtactccagtgcccttgaataataggggtaccttttcattcaagtttttatcataattacctattcttacacaagcttagtttttaaaatgtggacattttaaaggcctctggattttgctcatccagtgaagtccttgtaggacaataaacgtatatatgtacatatatacacaaacatgtatatgtgcacacacatgtatatgtataaatattttaaatggtgttttagaagcactttgtctacctaagctttgacaacttgaacaatgctaaggtactgagatgtttaaaaaacaagtttactttcattttagaatgcaaagttgatttttttaaggaaacaaagaaagcttttaaaatatttttgcttttagccatgcatctgctgatgagcaattgtgtccatttttaacacagccagttaaatccaccatggggcttactggattcaagggaatacgttagtccacaaaacatgttttctggtgctcatctcacatgctatactgtaaaacagttttatacaaaattgtatgacaagttcattgctcaaaaatgtacagttttaagaattttctattaactgcaggtaataattagctgcatgctgcagactcaacaaagctagttcactgaagcctatgctattttatggatcataggctcttcagagaactgaatggcagtctgcctttgtgttgataattatgtacattgtgacgttgtcatttcttagcttaagtgtcctctttaacaagaggattgagcagactgatgcctgcataagatgaataaacagggttagttccatgtgaatctgtcagttaaaaagaaacaaaaacaggcagctggtttgctgtggtggttttaaatcattaatttgtataaagaagtgaaagagttgtatagtaaattaaattgtaaacaaaacttttttaatgcaatgctttagtattttagtactgtaaaaaaattaaatatatacatatatatatatatatatatatatatatatatgagtttgaagcagaattcacatcatgatggtgctactcagcctgctacaaatatatcataatgtgagctaagaattcattaaatgtttgagtgatgttcctacttgtcatatacctcaacactagtttggcaataggatattgaactgagagtgaaagcattgtgtaccatcatttttttccaagtccttttttttattgttaaaaaaaaaagcataccttttttcaatacttgatttcttagcaagtataacttgaacttcaacctttttgttctaaaaattcagggatatttcagctcatgctctccctatgccaacatgtcacctgtgtttatgtaaaattgttgtaggttaataaatatattctttgtcagggatttaacccttttattttgaatcccttctattttacttgtacatgtgctgatgtaactaaaactaattttgtaaatctgttggctctttttattgtaaagaaaagcattttaaaagtttgaggaatcttttgactgtttcaagcaggaaaaaaaaattacatgaaaatagaatgcactgagttgataaagggaaaaattgtaaggcaggagtttccggcatgtgctgtaggccagcgacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaaccgctggcctacaagcacatggaagtatagtttggggggttggggagagtttacataaggaagagaagaaattgagtggcatattgtaaatatcagatctataattgtaaatataaaacctgcctcagttagaatgaatggaaagcagatctacaatttgctaatataggaatatcaggttgactatatagccatacttgaaaatgcttctgagtggtgtcaactttacttgaatgaatttttcatcttgattgacgcacagtgatgtacagttcacttctgaagctagtggttaacttgtgtaggaaacttttgcagtttgacactaagataacttctgtgtgcatttttctatgcttttttaaaaactagtttcatttcattttcatgagatgtttggtttataagatctgaggatggttataaatactgtaagtattgtaatgttatgaatgcaggttatttgaaagctgtttattattatatcattcctgataatgctatgtgagtgtttttaataaaatttatatttatttaatgcactctaa

SEQ ID NO: 418866 - DNA, 5137 bp, Homo sapiens
gtgggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagagaacttgcgcctgtcaggggctggatccagaaacctgtggtgcctccttctcttttggttgttcatggagcatgtactacaatggatgtaagtttgccagaagcaagatcccaaggaagtttaagctgcttggggatgacccaaaagaggaagagaaactggagtctcatttgcaaaacctgtccactcttatggcaccaacatataagaaacttgcacctgatgcatataataatcagattgaatatgaacacagagcaccagagtgccgtctgggtctgaaggaaggccgtccattctcaggggtcactgcatgtttggacttctgtgctcatgcccacagagacttgcacaacatgcagaatggcagcacattggtatgcactctcactagagaagacaatcgagaatttggaggaaaacctgaggatgagcagcttcacgttctgcctttatacaaagtctctgacgtggatgagtttgggagtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcagaacttttgcgactttcaggaccagtcatgcagcagtcccagcagccccagcctctacagaagcagccaccacagccccagcagcagcagagaccccagcagcagcagccacatcaccctcagacagagtctgtcaactcttattctgcttctggatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctggatcctgacattgggggagtggccgtggctccaactcatgggtcaattctcattgagtgtgcaaagcgtgagctgcatgccacaacccctttaaagaatcccaataggaatcaccccaccaggatctccctcgtcttttaccagcataagagcatgaatgagccaaaacatggcttggctctttgggaagccaaaatggctgaaaaagcccgtgagagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatgatatcacccccttttgttggttacctcacttgaaaagaccacaaccaacctgtcagtagtatagttctcatgacgtgggcagtggggaaaggtcacagtattcatgacaaatgtggtgggaaaaacctcagctcaccagcaacaaaagaggttatcttaccatagcacttaattttcactggctcccaagtggtcacagatggcatctaggaaaagaccaaagcattctatgcaaaaagaaggtggggaagaaagtgttccgcaatttacatttttaaacactggttctattattggacgagatgatatgtaaatgtgatcccccccccccgcttacaactctacacatctgtgaccacttttaataatatcaagtttgcatagtcatggaacacaaatcaaacaagtactgtagtattacagtgacaggaatcttaaaataccatctggtgctgaatatatgatgtactgaaatactggaattatggctttttgaaatgcagtttttactgtaatcttaacttttatttatcaaaatagctacaggaaacatgaatagcaggaaaacactgaatttgtttggatgttctaagaaatggtgctaagaaaatggtgtctttaatagctaaaaatttaatgcctttatatcatcaagatgctatcagtgtactccagtgcccttgaataataggggtaccttttcattcaagtttttatcataattacctattcttacacaagcttagtttttaaaatgtggacattttaaaggcctctggattttgctcatccagtgaagtccttgtaggacaataaacgtatatatgtacatatatacacaaacatgtatatgtgcacacacatgtatatgtataaatattttaaatggtgttttagaagcactttgtctacctaagctttgacaacttgaacaatgctaaggtactgagatgtttaaaaaacaagtttactttcattttagaatgcaaagttgatttttttaaggaaacaaagaaagcttttaaaatatttttgcttttagccatgcatctgctgatgagcaattgtgtccatttttaacacagccagttaaatccaccatggggcttactggattcaagggaatacgttagtccacaaaacatgttttctggtgctcatctcacatgctatactgtaaaacagttttatacaaaattgtatgacaagttcattgctcaaaaatgtacagttttaagaattttctattaactgcaggtaataattagctgcatgctgcagactcaacaaagctagttcactgaagcctatgctattttatggatcataggctcttcagagaactgaatggcagtctgcctttgtgttgataattatgtacattgtgacgttgtcatttcttagcttaagtgtcctctttaacaagaggattgagcagactgatgcctgcataagatgaataaacagggttagttccatgtgaatctgtcagttaaaaagaaacaaaaacaggcagctggtttgctgtggtggttttaaatcattaatttgtataaagaagtgaaagagttgtatagtaaattaaattgtaaacaaaacttttttaatgcaatgctttagtattttagtactgtaaaaaaattaaatatatacatatatatatatatatatatatatatatatatgagtttgaagcagaattcacatcatgatggtgctactcagcctgctacaaatatatcataatgtgagctaagaattcattaaatgtttgagtgatgttcctacttgtcatatacctcaacactagtttggcaataggatattgaactgagagtgaaagcattgtgtaccatcatttttttccaagtccttttttttattgttaaaaaaaaaagcataccttttttcaatacttgatttcttagcaagtataacttgaacttcaacctttttgttctaaaaattcagggatatttcagctcatgctctccctatgccaacatgtcacctgtgtttatgtaaaattgttgtaggttaataaatatattctttgtcagggatttaacccttttattttgaatcccttctattttacttgtacatgtgctgatgtaactaaaactaattttgtaaatctgttggctctttttattgtaaagaaaagcattttaaaagtttgaggaatcttttgactgtttcaagcaggaaggagtttccggcatgtgctgtaggccagcgacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaaccgctggcctacagcacatgccggtgtgctgtaggccagc

SEQ ID NO: 418867 - DNA, 1037 bp, Homo sapiens
  misc_feature (24)..(24): n is a, c, g, or t
  misc_feature (59)..(59): n is a, c, g, or t
catcatatacaattcagatccgtncccggcatgtgccgtcgccagcgagtctctgttanctctctcaattgacgttactttgatccttttttcacttgttttccctaaatccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaaccgctggcctacaagcacatggaagtatagtttggggggttggggagagtttacataaggaagagaagaaattgagtggcatattgtaaatatcagatctataattgtaaatataaaacctgcctcagttagaatgaatggaaagcagatctacaatttgctaatataggaatatcaggttgactatatagccatacttgaaaatgcttctgagtggtgtcaactttacttgaatgaatttttcatcttgattgacgcacagtgatgtacagttcacttctgaagctagtggttaacttgtgtaggaaacttttgcagtttgacactaagataacttctgtgtgcatttttctatgcttttttaaaaactagtttcatttcattttcatgagatgtttggtttataagatctgaggatggttataaatactgtaagtattgtaatgttatgaatgcaggttatttgaaagctgtttattattatatcattcctgataatgctatgtgagtgtttttaataaaatttatatttatttaatgcactctaa

SEQ ID NO: 418868 - DNA, 5195 bp, Homo sapiens
gtgggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagagaacttgcgcctgtcaggggctggatccagaaacctgtggtgcctccttctcttttggttgttcatggagcatgtactacaatggatgtaagtttgccagaagcaagatcccaaggaagtttaagctgcttggggatgacccaaaagaggaagagaaactggagtctcatttgcaaaacctgtccactcttatggcaccaacatataagaaacttgcacctgatgcatataataatcagattgaatatgaacacagagcaccagagtgccgtctgggtctgaaggaaggccgtccattctcaggggtcactgcatgtttggacttctgtgctcatgcccacagagacttgcacaacatgcagaatggcagcacattggtatgcactctcactagagaagacaatcgagaatttggaggaaaacctgaggatgagcagcttcacgttctgcctttatacaaagtctctgacgtggatgagtttgggagtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcagaacttttgcgactttcaggaccagtcatgcagcagtcccagcagccccagcctctacagaagcagccaccacagccccagcagcagcagagaccccagcagcagcagccacatcaccctcagacagagtctgtcaactcttattctgcttctggatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctggatcctgacattgggggagtggccgtggctccaactcatgggtcaattctcattgagtgtgcaaagcgtgagctgcatgccacaacccctttaaagaatcccaataggaatcaccccaccaggatctccctcgtcttttaccagcataagagcatgaatgagccaaaacatggcttggctctttgggaagccaaaatggctgaaaaagcccgtgagagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatgatatcacccccttttgttggttacctcacttgaaaagaccacaaccaacctgtcagtagtatagttctcatgacgtgggcagtggggaaaggtcacagtattcatgacaaatgtggtgggaaaaacctcagctcaccagcaacaaaagaggttatcttaccatagcacttaattttcactggctcccaagtggtcacagatggcatctaggaaaagaccaaagcattctatgcaaaaagaaggtggggaagaaagtgttccgcaatttacatttttaaacactggttctattattggacgagatgatatgtaaatgtgatcccccccccccgcttacaactctacacatctgtgaccacttttaataatatcaagtttgcatagtcatggaacacaaatcaaacaagtactgtagtattacagtgacaggaatcttaaaataccatctggtgctgaatatatgatgtactgaaatactggaattatggctttttgaaatgcagtttttactgtaatcttaacttttatttatcaaaatagctacaggaaacatgaatagcaggaaaacactgaatttgtttggatgttctaagaaatggtgctaagaaaatggtgtctttaatagctaaaaatttaatgcctttatatcatcaagatgctatcagtgtactccagtgcccttgaataataggggtaccttttcattcaagtttttatcataattacctattcttacacaagcttagtttttaaaatgtggacattttaaaggcctctggattttgctcatccagtgaagtccttgtaggacaataaacgtatatatgtacatatatacacaaacatgtatatgtgcacacacatgtatatgtataaatattttaaatggtgttttagaagcactttgtctacctaagctttgacaacttgaacaatgctaaggtactgagatgtttaaaaaacaagtttactttcattttagaatgcaaagttgatttttttaaggaaacaaagaaagcttttaaaatatttttgcttttagccatgcatctgctgatgagcaattgtgtccatttttaacacagccagttaaatccaccatggggcttactggattcaagggaatacgttagtccacaaaacatgttttctggtgctcatctcacatgctatactgtaaaacagttttatacaaaattgtatgacaagttcattgctcaaaaatgtacagttttaagaattttctattaactgcaggtaataattagctgcatgctgcagactcaacaaagctagttcactgaagcctatgctattttatggatcataggctcttcagagaactgaatggcagtctgcctttgtgttgataattatgtacattgtgacgttgtcatttcttagcttaagtgtcctctttaacaagaggattgagcagactgatgcctgcataagatgaataaacagggttagttccatgtgaatctgtcagttaaaaagaaacaaaaacaggcagctggtttgctgtggtggttttaaatcattaatttgtataaagaagtgaaagagttgtatagtaaattaaattgtaaacaaaacttttttaatgcaatgctttagtattttagtactgtaaaaaaattaaatatatacatatatatatatatatatatatatatatatatgagtttgaagcagaattcacatcatgatggtgctactcagcctgctacaaatatatcataatgtgagctaagaattcattaaatgtttgagtgatgttcctacttgtcatatacctcaacactagtttggcaataggatattgaactgagagtgaaagcattgtgtaccatcatttttttccaagtccttttttttattgttaaaaaaaaaagcataccttttttcaatacttgatttcttagcaagtataacttgaacttcaacctttttgttctaaaaattcagggatatttcagctcatgctctccctatgccaacatgtcacctgtgtttatgtaaaattgttgtaggttaataaatatattctttgtcagggatttaacccttttattttgaatcccttctattttacttgtacatgtgctgatgtaactaaaactaattttgtaaatctgttggctctttttattgtaaagaaaagcattttaaaagtttgaggaatcttttgactgtttcaagcaggaaaaaaaaattacatgaaaatagaatgcactgagttgataaagggaaaaattgtaaggcaggagtttccggcatgtgctgtaggccagcgacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaaccgctggcctacagcacatgccggtgtgctgtaggccagc

SEQ ID NO: 418869 - DNA, 352 bp, Homo sapiens
agtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcaggtaaatttaatgtaaagcatttgtagataaatgtgttgtgtggtatattaaaaatgaaaattattttggttttgcccccatcaacttgtaagttctggggtacac

SEQ ID NO: 418870 - DNA, 2686 bp, Homo sapiens
ggatctgaagaacaatgaaatttcctggactattgaagacatgaatggtgctttctatgggcttgacaaactgaggcgactgatactcacaaggaaatcggatccgttctattactaaaaaagcctccactggtttggatgcattggagcatctagacctgagtgacaacgcaatcatgtctttacaaggcaatgcattttcacaaatgaagaaactgcaacaattgcatttaaatacatcaagccttttgtgcgattgccagctaaaatggctcccacagtgggtggcggaaaacaactttcagagctttgtaaatgccagttgtgcccatcctcagctgctaaaaggaagaagcatttttgctgttagcccagatggctttgtgtgtgatgattttcccaaaccccagatcacggttcagccagaaacacagtcggcaataaaaggttccaatttgagtttcatctgctcagctgccagcagcagtgattccccaatgacttttgcttggaaaaaagacaatgaactactgcatgatgctgaaatggaaaattatgcacacctccgggcccaaggtggcgaggtgatggagtataccaccatccttcggctgcgcgaggtggaatttgccagtgaggggaaatatcagtgtgtcatctccaatcactttggttcatcctactctgtcaaagccaagcttacagtaaatatgcttccctcattcaccaagacccccatggatctcaccatccgagctggggccatggcacgcttggagtgtgctgctgtggggcacccagccccccagatagcctggcagaaggatgggggcacagacttcccagctgcacgggagagacgcatgcatgtgatgcccgaggatgacgtgttctttatcgtggatgtgaagatagaggacattggggtatacagctgcacagctcagaacagtgcaggaagtatttcagcaaatgcaactctgactgtcctagaaacaccatcatttttgcggccactgttggaccgaactgtaaccaagggagaaacagccgtcctacagtgcattgctggaggaagccctccccctaaactgaactggaccaaagatgatagcccattggtggtaaccgagaggcacttttttgcagcaggcaatcagcttctgattattgtggactcagatgtcagtgatgctgggaaatacacatgtgagatgtctaacacccttggcactgagagaggaaacgtgcgcctcagtgtgatccccactccaacctgcgactcccctcagatgacagccccatcgttagacgatgacggatgggccactgtgggtgtcgtgatcatagccgtggtttgctgtgtggtgggcacgtcactcgtgtgggtggtcatcatataccacacaaggcggaggaatgaagattgcagcattaccaacacagatgagaccaacttgccagcagatattcctagttatttgtcatctcagggaacgttagctgacaggcaggatgggtacgtgtcttcagaaagtggaagccaccaccagtttgtcacatcttcaggtgctggatttttcttaccacaacatgacagtagtgggacctgccatattgacaatagcagtgaagctgatgtggaagctgccacagatctgttcctttgtccgtttttgggatccacaggccctatgtatttgaagggaaatgtgtatggctcagatccttttgaaacatatcatacaggttgcagtcctgacccaagaacagttttaatggaccactatgagcccagttacataaagaaaaaggagtgctacccatgttctcatccttcagaagaatcctgcgaacggagcttcagtaatatatcgtggccttcacatgtgaggaagctacttaacactagttactctcacaatgaaggacctggaatgaaaaatctgtgtctaaacaagtcctctttagattttagtgcaaatccagagccagcgtcggttgcctcgagtaattctttcatgggtacctttggaaaagctctcaggagacctcacctagatgcctattcaagctttggacagccatcagattgtcagccaagagccttttatttgaaagctcattcttccccagacttggactctgggtcagaggaagatgggaaagaaaggacagattttcaggaagaaaatcacatttgtacctttaaacagactttagaaaactacaggactccaaattttcagtcttatgacttggacacatagactgaatgagaccaaaggaaaagcttaacatactacctcaagtgaacttttatttaaaagagagagaatcttatgttttttaaatggagttatgaattttaaaaggataaaaatgctttatttatacagatgaaccaaaattacaaaaagttatgaaaatttttatactgggaatgatgctcatataagaatacctttttaaactattttttaactttgttttatgcaaaaaagtatcttacgtaaattaatgatataaatcatgattattttatgtatttttataatgccagatttctttttatggaaaatgagttactaaagcattttaaataatacctgccttgtaccattttttaaatagaagttacttcattatattttgcacattatatttaataaaatgtgtcaatttg

SEQ ID NO: 418871 - DNA, 2785 bp, Homo sapiens
ggatctgaagaacaatgaaatttcctggactattgaagacatgaatggtgctttctatgggcttgacaaactgaggcgactgatactcacaaggaaatcggatccgttctattactaaaaaagcctccactggtttggatgcattggagcatctagacctgagtgacaacgcaatcatgtctttacaaggcaatgcattttcacaaatgaagaaactgcaacaattgcatttaaatacatcaagccttttgtgcgattgccagctaaaatggctcccacagtgggtggcggaaaacaactttcagagctttgtaaatgccagttgtgcccatcctcagctgctaaaaggaagaagcatttttgctgttagcccagatggctttgtgtgtgatgattttcccaaaccccagatcacggttcagccagaaacacagtcggcaataaaaggttccaatttgagtttcatctgctcagctgccagcagcagtgattccccaatgacttttgcttggaaaaaagacaatgaactactgcatgatgctgaaatggaaaattatgcacacctccgggcccaaggtggcgaggtgatggagtataccaccatccttcggctgcgcgaggtggaatttgccagtgaggggaaatatcagtgtgtcatctccaatcactttggttcatcctactctgtcaaagccaagcttacagtaaatatgcttccctcattcaccaagacccccatggatctcaccatccgagctggggccatggcacgcttggagtgtgctgctgtggggcacccagccccccagatagcctggcagaaggatgggggcacagacttcccagctgcacgggagagacgcatgcatgtgatgcccgaggatgacgtgttctttatcgtggatgtgaagatagaggacattggggtatacagctgcacagctcagaacagtgcaggaagtatttcagcaaatgcaactctgactgtcctagaaacaccatcatttttgcggccactgttggaccgaactgtaaccaagggagaaacagccgtcctacagtgcattgctggaggaagccctccccctaaactgaactggaccaaagatgatagcccattggtggtaaccgagaggcacttttttgcagcaggcaatcagcttctgattattgtggactcagatgtcagtgatgctgggaaatacacatgtgagatgtctaacacccttggcactgagagaggaaacgtgcgcctcagtgtgatccccactccaacctgcgactcccctcagatgacagccccatcgttagacgatgacggatgggccactgtgggtgtcgtgatcatagccgtggtttgctgtgtggtgggcacgtcactcgtgtgggtggtcatcatataccacacaaggcggaggaatgaagattgcagcattaccaacacagatgagaccaacttgccagcagatattcctagttatttgtcatctcagggaacgttagctgacaggcaggatgggtacgtgtcttcagaaagtggaagccaccaccagtttgtcacatcttcaggtgctggatttttcttaccacaacatgacagtagtgggacctgccatattgacaatagcagtgaagctgatgtggaagctgccacagatctgttcctttgtccgtttttgggatccacaggccctatgtatttgaagggaaatgtgtatggctcagatccttttgaaacatatcatacaggtaggtggttttcttgcttgagtacagttctgtttcttagagagacttctagatgtgctaactgtaatctccttctgttactgcccccatattaaaaaggttgcagtcctgacccaagaacagttttaatggaccactatgagcccagttacataaagaaaaaggagtgctacccatgttctcatccttcagaagaatcctgcgaacggagcttcagtaatatatcgtggccttcacatgtgaggaagctacttaacactagttactctcacaatgaaggacctggaatgaaaaatctgtgtctaaacaagtcctctttagattttagtgcaaatccagagccagcgtcggttgcctcgagtaattctttcatgggtacctttggaaaagctctcaggagacctcacctagatgcctattcaagctttggacagccatcagattgtcagccaagagccttttatttgaaagctcattcttccccagacttggactctgggtcagaggaagatgggaaagaaaggacagattttcaggaagaaaatcacatttgtacctttaaacagactttagaaaactacaggactccaaattttcagtcttatgacttggacacatagactgaatgagaccaaaggaaaagcttaacatactacctcaagtgaacttttatttaaaagagagagaatcttatgttttttaaatggagttatgaattttaaaaggataaaaatgctttatttatacagatgaaccaaaattacaaaaagttatgaaaatttttatactgggaatgatgctcatataagaatacctttttaaactattttttaactttgttttatgcaaaaaagtatcttacgtaaattaatgatataaatcatgattattttatgtatttttataatgccagatttctttttatggaaaatgagttactaaagcattttaaataatacctgccttgtaccattttttaaatagaagttacttcattatattttgcacattatatttaataaaatgtgtcaatttg

SEQ ID NO: 418872 - DNA, 2730 bp, Homo sapiens
ggatctgaagaacaatgaaatttcctggactattgaagacatgaatggtgctttctatgggcttgacaaactgaggcgactgatactcacaaggaaatcggatccgttctattactaaaaaagcctccactggtttggatgcattggagcatctagacctgagtgacaacgcaatcatgtctttacaaggcaatgcattttcacaaatgaagaaactgcaacaattgcatttaaatacatcaagccttttgtgcgattgccagctaaaatggctcccacagtgggtggcggaaaacaactttcagagctttgtaaatgccagttgtgcccatcctcagctgctaaaaggaagaagcatttttgctgttagcccagatggctttgtgtgtgatgattttcccaaaccccagatcacggttcagccagaaacacagtcggcaataaaaggttccaatttgagtttcatctgctcagctgccagcagcagtgattccccaatgacttttgcttggaaaaaagacaatgaactactgcatgatgctgaaatggaaaattatgcacacctccgggcccaaggtggcgaggtgatggagtataccaccatccttcggctgcgcgaggtggaatttgccagtgaggggaaatatcagtgtgtcatctccaatcactttggttcatcctactctgtcaaagccaagcttacagtaaatatgcttccctcattcaccaagacccccatggatctcaccatccgagctggggccatggcacgcttggagtgtgctgctgtggggcacccagccccccagatagcctggcagaaggatgggggcacagacttcccagctgcacgggagagacgcatgcatgtgatgcccgaggatgacgtgttctttatcgtggatgtgaagatagaggacattggggtatacagctgcacagctcagaacagtgcaggaagtatttcagcaaatgcaactctgactgtcctagaaacaccatcatttttgcggccactgttggaccgaactgtaaccaagggagaaacagccgtcctacagtgcattgctggaggaagccctccccctaaactgaactggaccaaagatgatagcccattggtggtaaccgagaggcacttttttgcagcaggcaatcagcttctgattattgtggactcagatgtcagtgatgctgggaaatacacatgtgagatgtctaacacccttggcactgagagaggaaacgtgcgcctcagtgtgatccccactccaacctgcgactcccctcagatgacagccccatcgttagacgatgacggatgggccactgtgggtgtcgtgatcatagccgtggtttgctgtgtggtgggcacgtcactcgtgtgggtggtcatcatataccacacaaggcggaggaatgaagattgcagcattaccaacacagatgagaccaacttgccagcagatattcctagttatttgtcatctcagggaacgttagctgacaggcaggatgggtacgtgtcttcagaaagtggaagccaccaccagtttgtcacatcttcaggtgctggatttttcttaccacaacatgacagtagtgggacctgccatattgacaatagcagtgaagctgatgtggaagctgccacagatctgttcctttgtccgtttttgggatccacaggccctatgtatttgaagggaaatgtgtatggctcagatccttttgaaacatatcatacaggttgcagtcctgacccaagaacagttttaatggaccactatgagcccagttacataaagaaaaaggagtgctacccatgttctcatccttcagaagaatcctgcgaacggagcttcagtaatatatcgtggccttcacatgtgaggaagctacttaacactagttactctcacaatgaaggacctggaatgaaaaatctgtgtctaaacaagtcctctttagattttagtgcaaatccagagccagcgtcggttgcctcgagtaattctttcatgggtacctttggaaaagctctcaggagacctcacctagatgcctattcaagctttggacagccatcagattgtcagccaagagccttttatttgaaagctcattcttccccagacttggactctgggtcagaggaagatgggaaagaaaggacagattttcaggaagaaaatcacatttgtacctttaaacagactttagaaaactacaggactccaaattttcagtcttatgacttggacacatagactgaatgagaccaaaggaaaagcttaacatactacctcaagtgaacttttatttaaaagagagagaatcttatgttttttaaatggagttatgaattttaaaaggataaaaatgctttatttatacagatgaaccaaaattacaaaaagttatgaaaatttttatactgggaatgatgctcatataagaatacctttttaaactattttttaactttgttttatgcaaaaaagtatcttacgtaaattaatgatataaatcatgattattttatgtatttttataatgccagatttctttttatggaaaatgagttactaaagcattttaaataatacctgccttgtaccattttttaaatagaagttacttcattatattttgcacattatatttaataaaatgtgtcaatttgatgccaagccccatttatacaataacaatttttattatttttag

SEQ ID NO: 418873 - DNA, 1465 bp, Homo sapiens
acaggatccaaaatggcagcgctgtcgccttagctgggagagcgagccgttgtggctgtttgggagacttatggtcaccctgaagtactgcctgcctctagtgtcgcgtccctccagtatccgatgggagcgccgtccgcagggaatgtgtctctctgatcatggtgcctcgtgtccagctctggggaagaccgagacgaaatcgagtcagctggcgttgggagagggcttatttccgcttccgcttgcccactttcaggaatttgattctgagagcagggctgcggttccaggcagggtttgtacacatatttgcgttggaaggagagaggagcctaggacacatatgtattaactgtgcagctggtccgactcccgacagcttcagcgcacaccagccagccttggagttgctggaacggccctggctgcaagctggaatcacccggagagctttcgacattgatgcctgaggcccagctgtggagcgacagtttgaaaagagctgcaggtgactctaatgtgcagctaaagctaggaaccactgagctacatctcagggaagactgaaaattacaaagaatatgataaaatcttacttcaggaacaaagctacgtttttccaggttaatttattagtggttgggtttttttaagtttttgtgggtacacagtaggtgtgaacatttatgggccacctgagatattttgacacaggcatgcaataagtaataatctcatcaggacaaatgggatatccatcacctcaagcatttgtcctttgtgttacaaacgatccagttatattcttttagttactttaaaatatacaatattattggctgtaattactctgatgtgctatcaaatactagttatactatttcttattctattttttgtacccattaactatccccacttccccaccccgccaacccttcccagtctgttaaccatccttctactctccatctccataagactacactttcattcaaaaaatccaaattgctcaccataagcaaggcacagttacaaatatgagtaagttactgccccaaatgaactcttggtccaatggaaaaaatcagaatgtaaaatcacaatagaggcagtatgttctataattatgtcacattcaacatactatgagagtacaatggaggaagctattaactatggccgggaaaggtgggaaaggattcctttcactggtatacttaaatacttaagaaaaaaaaagtgtgatctaaacagtgaatagtacatgcaaaggcatagtctagaggataaaagtgaaaataattagtagcaaaatgaatgccttgtggatgaggtttaggggccaataactatcttgaggtaaggccaggttgtggctgcctttgtgttgtactaaggggtttggaccttcctaggagattagagcttgattaaagtcacaacatccataagagaaata

SEQ ID NO: 418874 - DNA, 691 bp, Homo sapiens
tagcctgatacgattgagctcgtaccatatgttggacgactttatatgggcagattttatggtaaatatacctcaataaaatcatttttcaaaatcaaatttacacatataccaaccattgctaaacaagtattcctgttttgtttgttacttcaagccatctatgcatttttggtatcactttttattttctgtaacagttacccctacatttactgggtctcagaaccttgtcaggctctgctttaaagttcctaccatgttggctctgtaactcaggtggagaagcctagaccaggagctggcgtagaccaaaggatacttgcctaataaggattagcttatactgaggaaaatactttaagcatttaaagtccagatgaggaagttgagcccagaattcagggaaccagctcaaagtgggcccatgcagacaggctgggtctaagagtccacaaggttggccagggcaggtaggatgcacaggaggcatctggatctggaagtacttggacagctgaggtcaagatcacacagaaatttattcctggacagccaaggtttacaggagcagaaatagcaaatattttcttgctccgtctctcccttttttcccagtgcccttttctgtacctacccagatcactttatacctagacatctgtcacaattttgtaactggtcttcgtcc

SEQ ID NO: 418875 - DNA, 1012 bp, Homo sapiens
acaggatccaaaatggcagcgctgtcgccttagctgggagagcgagccgttgtggctgtttgggagacttatggtcaccctgaagtactgcctgcctctagtgtcgcgtccctccagtatccgatgggagcgccgtccgcagggaatgtgtctctctgatcatggtgcctcgtgtccagctctggggaagaccgagacgaaatcgagtcagctggcgttgggagagggcttatttccgcttccgcttgcccactttcaggaatttgattctgagagcagggctgcggttccaggcagggtttgtacacatatttgcgttggaaggagagaggagcctaggacacatatgtattaactgtgcagctggtccgactcccgacagcttcagcgcacaccagccagccttggagttgctggaacggccctggctgcaagctggaatcacccggagagctttcgacattgatgcctgaggcccagctgtggagcgacagtttgaaaagagctgcagcttccccttctcagaatcctgctcttcctccagagagattcccaggagaagagggaacaaccaattcattcctgaaagccaggcctcgggacctgatgacatttgaagatgtggctgtggaattcagccagtgggagtgggggcagctgaaccctgctcagaaggacctctacagggaggtgatgctggagaacttcaggaacttggccattctgggccttctagtatccaaaccatatgtgatctgccagttggaggaagggggtgagcccttcatggtggagagagaaatctcaacaggagcccactcagactggaagagaaggtctaaatccaaggaatcaatgccaagttggggaatttccaaagaagaattattccagcttcatgaggaattacctgtgaccagttgcctgaagaagaaaactcttgggcttggtttactcatggttctgcatgatctgttggtatcacctgaaagtggacagctgcagtactgca

SEQ ID NO: 418876 - DNA, 4470 bp, Homo sapiens
acaggatccaaaatggcagcgctgtcgccttagctgggagagcgagccgttgtggctgtttgggagacttatggtcaccctgaagtactgcctgcctctagtgtcgcgtccctccagtatccgatgggagcgccgtccgcagggaatgtgtctctctgatcatggtgcctcgtgtccagctctggggaagaccgagacgaaatcgagtcagctggcgttgggagagggcttatttccgcttccgcttgcccactttcaggaatttgattctgagagcagggctgcggttccaggcagggtttgtacacatatttgcgttggaaggagagaggagcctaggacacatatgtattaactgtgcagctggtccgactcccgacagcttcagcgcacaccagccagccttggagttgctggaacggccctggctgcaagctggaatcacccggagagctttcgacattgatgcctgaggcccagctgtggagcgacagtttgaaaagagctgcaggtgactctaatgtgcagctaaagctaggaaccactgagctacatctcagggaagactgaaaattacaaagaatatgataaaatcttacttcaggaacaaagctacgtttttccagcttccccttctcagaatcctgctcttcctccagagagattcccaggagaagagggaacaaccaattcattcctgaaagccaggcctcgggacctgatgacatttgaagatgtggctgtggaattcagccagtgggagtgggggcagctgaaccctgctcagaaggacctctacagggaggtgatgctggagaacttcaggaacttggccattctgggccttctagtatccaaaccatatgtgatctgccagttggaggaagggggtgagcccttcatggtggagagagaaatctcaacaggagcccactcagactggaagagaaggtctaaatccaaggaatcaatgccaagttggggaatttccaaagaagaattattccaggtagtatcagtggaaaaacacattcaagatgtgctgcagttctcgaagttgaaagcagcctgcggttgtgatggccagttagagatgcagcagataaaacaggagagacacctgaaacaaatgtcaaccattcacaaatctgccaccacccttagcagagattataaatggaatggatttgggagaagcttaggtttaagatcagtccttgttaaccaacacagcattctcatgggagaaggatcttataaatgtgatacagaattcaggcagactttagggggaaacaactctcagagaacccacccagaaaagaaatcttgtaaatgtaatgagtgtgggaagtcctttcacttccagtcagaacttaggcgccatcagcgatgtcacactggagaaaagccgtatgaatgcagtgactgtggaagagcctttggtcatatttcatcccttattaaacatcaaagaactcatactggagaaaagccctatgaatgcagtgaatgtgggagagccttcagccagagttcgtctcttgttctgcactatagatttcacactggagagaaaccctacaaatgtaatgaatgtggacgagcctttggtcacacttcatcccttattaagcatcagaggactcatactggagaaaagccctatgaatgccgggaatgtgggagaaccttcagccagagctcatcactcattgtgcattacagatttcatactggagagaaaccttacaaatgtaataaatgtgggagagccttcagccagagttcatctctcactcaacattacagatttcacactggagagaaaccctacaaatgtaatgagtgtggaagggcctttgctcatactgcatcccttattaaacatcagagaagtcatgctggaaaaaaaaccctataaattcagtgaatatagaagggctttcagctggagtgcagacatcactggaacttaaagaattcatatcagagagagatcctaaaggtgtaatgtatgtgggaagaccacatcttgttccacatcaggcaataattactaaagagaatccctgtcaatgtcaagagggggtgggcttcccctctcttaccaaacatgggagaatccatactagtgagaaaccacgtgaatgtaatgaatgtgggaacgctttgatcagaggatgcatattattcagcatcagacagccgacactggggaggagccttatcaatgcagtgagtgtggcaagccttcagttacatactgattctttaagaaaatcagataacttgtactggagagaaatcctacaagtgtggtaagtatggaaaaatcttcagttgtatctcttcctttactaagcatcaagaacacatactagagagaggccctatgaaagcaggaaatagaggaaggccttcagtcagggctcatcccttattaagcatcagaaaattcatacctgagaaaaacctgtgaatgtgggtaatgtgggagagccttcagccaaacctcattgctttataaaccccttagaactctccctactagctggaaactctggtgacgtgatgaatgtgggaagggctttggtggatgttccaccaaaacacgttagagaatttgtacattagagaatttgtgctagagcaactcttcaaatttagtgaaactgggaaaacccattagtagagttcaagcttcagtattcatctcaaagagaaaccttgggaacatgatgaatgtgaggaaagttcctttccaacttgagatgtataaaactagagctgaaaagaagctgagaaatcaccttgtctggtgattttctgcctggtggggccatttgtataacgacacttgtgcattgcctcctcatgctgttactgacggggcagggtgtcatgcatgggtgcagaggatggaggctgagaaaggtagacagctacccatgatctagcccagtcgtattttagagctaataaaactgatgttcagaaagtgacatgccttggcctatagtcctaactgggctgggcctctttcctgtggttcacagctgtagtatggagattaatagactggatctttgcagtacaacacctctatgcacttctttctctgtagcacatgttacctttctttgtgaggcaatggagtggtctaggattgagcaaaaagcaatttttgttacatctttatgctaatagatttggaatttttgaaatgaaatgaaaccttgtttaaacattaaaattactaaaataggctgggcgcggtggctcacgcctgtaacctcagcactttgggaggccgaggcggacagatcacgaggtcaggagttcgagaccatcctggctaacacagtgaaaccctgtctctcctaaaaatacaaaaaaattagccaggcatggtggcgggcgcctgtagtcccagctacttggaaggctgagacaggagaatggcgtgaatcggggaggcagagcttgcagtcagccgagatcacgccactgcactccagcctgggagacagagtgagactccgtctcagaaaaaaaaaaaaaaaacaactaaaatatgggtattatgcacaatccagatctcaaaaacgtgattctaagtgaaagaaggcagatgccagagaccaggtattttctagtaccattttaggaaatgtccagaaatggcagatcttcagaaacaaagtaactgcaaatgttacaaggaatctttttagggtgacgaaaatgttctaaaactagatggtggtgatggttgaacgatttggtaacttcactaaaaatcattgaattgttcactttatatgggcagattttatggtaaatatacctcaataaaatcatttttcaaaatcaaatttacacatataccaaccattgctaaacaagtattcctgttttgtttgttacttcaagccatctatgcatttttggtatcactttttattttctgtaacagttacccctacatttactgggtctcagaaccttgtcaggctctgctttaaagttcctaccatgttggctctgtaactcaggtggagaagcctagaccaggagctggcgtagaccaaaggatacttgcctaataaggattagcttatactgaggaaaatactttaagcatttaaagtccagatgaggaagttgagcccagaattcagggaaccagctcaaagtgggcccatgcagacaggctgggtctaagagtccacaaggttggccagggcaggtaggatgcacaggaggcatctggatctggaagtacttggacagctgaggtcaagatcacacagaaatttattcctggacagccaaggtttacaggagcagaaatagcaaatattttcttgctccgtctctcccttttttcccagtgcccttttctgtacctacccagatcactttatacctagacatctgtcacaattttgtaactggtcttcgtcc

SEQ ID NO: 418877 - DNA, 3386 bp, Homo sapiens
acaggatccaaaatggcagcgctgtcgccttagctgggagagcgagccgttgtggctgtttgggagacttatggtcaccctgaagtactgcctgcctctagtgtcgcgtccctccagtatccgatgggagcgccgtccgcagggaatgtgtctctctgatcatggtgcctcgtgtccagctctggggaagaccgagacgaaatcgagtcagctggcgttgggagagggcttatttccgcttccgcttgcccactttcaggaatttgattctgagagcagggctgcggttccaggcagggtttgtacacatatttgcgttggaaggagagaggagcctaggacacatatgtattaactgtgcagctggtccgactcccgacagcttcagcgcacaccagccagccttggagttgctggaacggccctggctgcaagctggaatcacccggagagctttcgacattgatgcctgaggcccagctgtggagcgacagtttgaaaagagctgcaggtgactctaatgtgcagctaaagctaggaaccactgagctacatctcagggaagactgaaaattacaaagaatatgataaaatcttacttcaggaacaaagctacgtttttccagcttccccttctcagaatcctgctcttcctccagagagattcccaggagaagagggaacaaccaattcattcctgaaagccaggcctcgggacctgatgacatttgaagatgtggctgtggaattcagccagtgggagtgggggcagctgaaccctgctcagaaggacctctacagggaggtgatgctggagaacttcaggaacttggccattctgggccttctagtatccaaaccatatgtgatctgccagttggaggaagggggtgagcccttcatggtggagagagaaatctcaacaggagcccactcagactggaagagaaggtctaaatccaaggaatcaatgccaagttggggaatttccaaagaagaattattccaggtagtatcagtggaaaaacacattcaagatgtgctgcagttctcgaagttgaaagcagcctgcggttgtgatggccagttagagatgcagcagataaaacaggagagacacctgaaacaaatgtcaaccattcacaaatctgccaccacccttagcagagattataaatggaatggatttgggagaagcttaggtttaagatcagtccttgttaaccaacacagcattctcatgggagaaggatcttataaatgtgatacagaattcaggcagactttagggggaaacaactctcagagaacccacccagaaaagaaatcttgtaaatgtaatgagtgtgggaagtcctttcacttccagtcagaacttaggcgccatcagcgatgtcacactggagaaaagccgtatgaatgcagtgactgtggaagagcctttggtcatatttcatcccttattaaacatcaaagaactcatactggagaaaagccctatgaatgcagtgaatgtgggagagccttcagccagagttcgtctcttgttctgcactatagatttcacactggagagaaaccctacaaatgtaatgaatgtggacgagcctttggtcacacttcatcccttattaagcatcagaggactcatactggagaaaagccctatgaatgccgggaatgtgggagaaccttcagccagagctcatcactcattgtgcattacagatttcatactggagagaaaccttacaaatgtaataaatgtgggagagccttcagccagagttcatctctcactcaacattacagatttcacactggagagaaaccctacaaatgtaatgagtgtggaagggcctttgctcatactgcatcccttattaaacatcagagaagtcatgctggaaaaaaaaccctataaattcagtgaatatagaagggctttcagctggagtgcagacatcactggaacttaaagaattcatatcagagagagatcctaaaggtgtaatgtatgtgggaagaccacatcttgttccacatcaggcaataattactaaagagaatccctgtcaatgtcaagagggggtgggcttcccctctcttaccaaacatgggagaatccatactagtgagaaaccacgtgaatgtaatgaatgtgggaacgctttgatcagaggatgcatattattcagcatcagacagccgacactggggaggagccttatcaatgcagtgagtgtggcaagccttcagttacatactgattctttaagaaaatcagataacttgtactggagagaaatcctacaagtgtggtaagtatggaaaaatcttcagttgtatctcttcctttactaagcatcaagaacacatactagagagaggccctatgaaagcaggaaatagaggaaggccttcagtcagggctcatcccttattaagcatcagaaaattcatacctgagaaaaacctgtgaatgtgggtaatgtgggagagccttcagccaaacctcattgctttataaaccccttagaactctccctactagctggaaactctggtgacgtgatgaatgtgggaagggctttggtggatgttccaccaaaacacgttagagaatttgtacattagagaatttgtgctagagcaactcttcaaatttagtgaaactgggaaaacccattagtagagttcaagcttcagtattcatctcaaagagaaaccttgggaacatgatgaatgtgaggaaagttcctttccaacttgagatgtataaaactagagctgaaaagaagctgagaaatcaccttgtctggtgattttctgcctggtggggccatttgtataacgacacttgtgcattgcctcctcatgctgttactgacggggcagggtgtcatgcatgggtgcagaggatggaggctgagaaaggtagacagctacccatgatctagcccagtcgtattttagagctaataaaactgatgttcagaaagtgacatgccttggcctatagtcctaactgggctgggcctctttcctgtggttcacagctgtagtatggagattaatagactggatctttgcagtacaacacctctatgcacttctttctctgtagcacatgttacctttctttgtgaggcaatggagtggtctaggattgagcaaaaagcaatttttgttacatctttatgctaatagatttggaatttttgaaatgaaatgaaaccttgtttaaacattaaaattactaaaataggctgagccacggcgcccagccttcacatttcatttcttgtacgtcgttttgttttcccaggtgttaatgatatccctatttttcacttaattattaatgttatgagttgtctacctgc

SEQ ID NO: 418878 - DNA, 2804 bp, Homo sapiens
acaggatccaaaatggcagcgctgtcgccttagctgggagagcgagccgttgtggctgtttgggagacttatggtcaccctgaagtactgcctgcctctagtgtcgcgtccctccagtatccgatgggagcgccgtccgcagggaatgtgtctctctgatcatggtgcctcgtgtccagctctggggaagaccgagacgaaatcgagtcagctggcgttgggagagggcttatttccgcttccgcttgcccactttcaggaatttgattctgagagcagggctgcggttccaggcagggtttgtacacatatttgcgttggaaggagagaggagcctaggacacatatgtattaactgtgcagctggtccgactcccgacagcttcagcgcacaccagccagccttggagttgctggaacggccctggctgcaagctggaatcacccggagagctttcgacattgatgcctgaggcccagctgtggagcgacagtttgaaaagagctgcaggtgactctaatgtgcagctaaagctaggaaccactgagctacatctcagggaagactgaaaattacaaagaatatgataaaatcttacttcaggaacaaagctacgtttttccagcttccccttctcagaatcctgctcttcctccagagagattcccaggagaagagggaacaaccaattcattcctgaaagccaggcctcgggacctgatgacatttgaagatgtggctgtggaattcagccagtgggagtgggggcagctgaaccctgctcagaaggacctctacagggaggtgatgctggagaacttcaggaacttggccattctgggccttctagtatccaaaccatatgtgatctgccagttggaggaagggggtgagcccttcatggtggagagagaaatctcaacaggagcccactcagactggaagagaaggtctaaatccaaggaatcaatgccaagttggggaatttccaaagaagaattattccaggtagtatcagtggaaaaacacattcaagatgtgctgcagttctcgaagttgaaagcagcctgcggttgtgatggccagttagagatgcagcagataaaacaggagagacacctgaaacaaatgtcaaccattcacaaatctgccaccacccttagcagagattataaatggaatggatttgggagaagcttaggtttaagatcagtccttgttaaccaacacagcattctcatgggagaaggatcttataaatgtgatacagaattcaggcagactttagggggaaacaactctcagagaacccacccagaaaagaaatcttgtaaatgtaatgagtgtgggaagtcctttcacttccagtcagaacttaggcgccatcagcgatgtcacactggagaaaagccgtatgaatgcagtgactgtggaagagcctttggtcatatttcatcccttattaaacatcaaagaactcatactggagaaaagccctatgaatgcagtgaatgtgggagagccttcagccagagttcgtctcttgttctgcactatagatttcacactggagagaaaccctacaaatgtaatgaatgtggacgagcctttggtcacacttcatcccttattaagcatcagaggactcatactggagaaaagccctatgaatgccgggaatgtgggagaaccttcagccagagctcatcactcattgtgcattacagatttcatactggagagaaaccttacaaatgtaataaatgtgggagagccttcagccagagttcatctctcactcaacattacagatttcacactggagagaaaccctacaaatgtaatgagtgtggaagggcctttgctcatactgcatcccttattaaacatcagagaagtcatgctggaaaaaaaaccctataaattcagtgaatatagaagggctttcagctggagtgcagacatcactggaacttaaagaattcatatcagagagagatcctaaaggtgtaatgtatgtgggaagaccacatcttgttccacatcaggcaataattactaaagagaatccctgtcaatgtcaagagggggtgggcttcccctctcttaccaaacatgggagaatccatactagtgagaaaccacgtgaatgtaatgaatgtgggaacgctttgatcagaggatgcatattattcagcatcagacagccgacactggggaggagccttatcaatgcagtgagtgtggcaagccttcagttacatactgattctttaagaaaatcagataacttgtactggagagaaatcctacaagtgtggtaagtatggaaaaatcttcagttgtatctcttcctttactaagcatcaagaacacatactagagagaggccctatgaaagcaggaaatagaggaaggccttcagtcagggctcatcccttattaagcatcagaaaattcatacctgagaaaaacctgtgaatgtgggtaatgtgggagagccttcagccaaacctcattgctttataaaccccttagaactctccctactagctggaaactctggtgacgtgatgaatgtgggaagggctttggtggatgttccaccaaaacacgttagagaatttgtacattagagaatttgtgctagagcaactcttcaaatttagtgaaactgggaaaacccattagtagagttcaagcttcagtattcatctcaaagagaaaccttgggaacatgatgaatgtgaggaaagttcctttccaacttgaggtcgacgcggccgcgaatttagtagtagta

SEQ ID NO: 418879 - DNA, 870 bp, Homo sapiens
acaggatccaaaatggcagcgctgtcgccttagctgggagagcgagccgttgtggctgtttgggagacttatggtcaccctgaagtactgcctgcctctagtgtcgcgtccctccagtatccgatgggagcgccgtccgcagggaatgtgtctctctgatcatggtgcctcgtgtccagctctggggaagaccgagacgaaatcgagtcagctggcgttgggagagggcttatttccgcttccgcttgcccactttcaggaatttgattctgagagcagggctgcggttccaggcagggtttgtacacatatttgcgttggaaggagagaggagcctaggacacatatgtattaactgtgcagctggtccgactcccgacagcttcagcgcacaccagccagccttggagttgctggaacggccctggctgcaagctggaatcacccggagagctttcgacattgatgcctgaggcccagctgtggagcgacagtttgaaaagagctgcaggtgactctaatgtgcagctaaagctaggaaccactgagctacatctcagggaagactgaaaattacaaagaatatgataaaatcttacttcaggaacaaagctacgtttttccagcctccccttctcagaatcctgctcttcctccaactggcagatcacatatggtttggatactagagggcccagaatggccaagttcctgaagtactccagcatcacctccctgtagaggtccttctgagcagggttcagctgcccccactcccactggctgaattccacagccacatcttcaaatgtcatcaggtcccgaggcctggctttcaggaatgaattggttgttccctctttcctggga

SEQ ID NO: 418880 - DNA, 4123 bp, Homo sapiens
acagagctgggtgtgtccctccgagtgccccccgctagggactgtgcaggccggagctaggcagggacagcggggcgaaccgggctgatagagtcggtccctgctcctgtgaggctctcaccgaatccctgctgtttccgggcagctgaagagcgctgggccctcgcgtcgcgggcgtggctgtggccgtgtctcctggtagtctgagcccactgtgcgtgtggatccacgtgggagctgggttccagagcctggtcctgaggaggagccgagccggggcttccccttctcagaatcctgctcttcctccagagagattcccaggagaagagggaacaaccaattcattcctgaaagccaggcctcgggacctgatgacatttgaagatgtggctgtggaattcagccagtgggagtgggggcagctgaaccctgctcagaaggacctctacagggaggtgatgctggagaacttcaggaacttggccattctgggccttctagtatccaaaccatatgtgatctgccagttggaggaagggggtgagcccttcatggtggagagagaaatctcaacaggagcccactcagactggaagagaaggtctaaatccaaggaatcaatgccaagttggggaatttccaaagaagaattattccaggtagtatcagtggaaaaacacattcaagatgtgctgcagttctcgaagttgaaagcagcctgcggttgtgatggccagttagagatgcagcagataaaacaggagagacacctgaaacaaatgtcaaccattcacaaatctgccaccacccttagcagagattataaatggaatggatttgggagaagcttaggtttaagatcagtccttgttaaccaacacagcattctcatgggagaaggatcttataaatgtgatacagaattcaggcagactttagggggaaacaactctcagagaacccacccagaaaagaaatcttgtaaatgtaatgagtgtgggaagtcctttcacttccagtcagaacttaggcgccatcagcgatgtcacactggagaaaagccgtatgaatgcagtgactgtggaagagcctttggtcatatttcatcccttattaaacatcaaagaactcatactggagaaaagccctatgaatgcagtgaatgtgggagagccttcagccagagttcgtctcttgttctgcactatagatttcacactggagagaaaccctacaaatgtaatgaatgtggacgagcctttggtcacacttcatcccttattaagcatcagaggactcatactggagaaaagccctatgaatgccgggaatgtgggagaaccttcagccagagctcatcactcattgtgcattacagatttcatactggagagaaaccttacaaatgtaataaatgtgggagagccttcagccagagttcatctctcactcaacattacagatttcacactggagagaaaccctacaaatgtaatgagtgtggaagggcctttgctcatactgcatcccttattaaacatcagagaagtcatgctggaaaaaaaaccctataaattcagtgaatatagaagggctttcagctggagtgcagacatcactggaacttaaagaattcatatcagagagagatcctaaaggtgtaatgtatgtgggaagaccacatcttgttccacatcaggcaataattactaaagagaatccctgtcaatgtcaagagggggtgggcttcccctctcttaccaaacatgggagaatccatactagtgagaaaccacgtgaatgtaatgaatgtgggaacgctttgatcagaggatgcatattattcagcatcagacagccgacactggggaggagccttatcaatgcagtgagtgtggcaagccttcagttacatactgattctttaagaaaatcagataacttgtactggagagaaatcctacaagtgtggtaagtatggaaaaatcttcagttgtatctcttcctttactaagcatcaagaacacatactagagagaggccctatgaaagcaggaaatagaggaaggccttcagtcagggctcatcccttattaagcatcagaaaattcatacctgagaaaaacctgtgaatgtgggtaatgtgggagagccttcagccaaacctcattgctttataaaccccttagaactctccctactagctggaaactctggtgacgtgatgaatgtgggaagggctttggtggatgttccaccaaaacacgttagagaatttgtacattagagaatttgtgctagagcaactcttcaaatttagtgaaactgggaaaacccattagtagagttcaagcttcagtattcatctcaaagagaaaccttgggaacatgatgaatgtgaggaaagttcctttccaacttgagatgtataaaactagagctgaaaagaagctgagaaatcaccttgtctggtgattttctgcctggtggggccatttgtataacgacacttgtgcattgcctcctcatgctgttactgacggggcagggtgtcatgcatgggtgcagaggatggaggctgagaaaggtagacagctacccatgatctagcccagtcgtattttagagctaataaaactgatgttcagaaagtgacatgccttggcctatagtcctaactgggctgggcctctttcctgtggttcacagctgtagtatggagattaatagactggatctttgcagtacaacacctctatgcacttctttctctgtagcacatgttacctttctttgtgaggcaatggagtggtctaggattgagcaaaaagcaatttttgttacatctttatgctaatagatttggaatttttgaaatgaaatgaaaccttgtttaaacattaaaattactaaaataggctgggcgcggtggctcacgcctgtaacctcagcactttgggaggccgaggcggacagatcacgaggtcaggagttcgagaccatcctggctaacacagtgaaaccctgtctctcctaaaaatacaaaaaaattagccaggcatggtggcgggcgcctgtagtcccagctacttggaaggctgagacaggagaatggcgtgaatcggggaggcagagcttgcagtcagccgagatcacgccactgcactccagcctgggagacagagtgagactccgtctcagaaaaaaaaaaaaaaaacaactaaaatatgggtattatgcacaatccagatctcaaaaacgtgattctaagtgaaagaaggcagatgccagagaccaggtattttctagtaccattttaggaaatgtccagaaatggcagatcttcagaaacaaagtaactgcaaatgttacaaggaatctttttagggtgacgaaaatgttctaaaactagatggtggtgatggttgaacgatttggtaacttcactaaaaatcattgaattgttcactttatatgggcagattttatggtaaatatacctcaataaaatcatttttcaaaatcaaatttacacatataccaaccattgctaaacaagtattcctgttttgtttgttacttcaagccatctatgcatttttggtatcactttttattttctgtaacagttacccctacatttactgggtctcagaaccttgtcaggctctgctttaaagttcctaccatgttggctctgtaactcaggtggagaagcctagaccaggagctggcgtagaccaaaggatacttgcctaataaggattagcttatactgaggaaaatactttaagcatttaaagtccagatgaggaagttgagcccagaattcagggaaccagctcaaagtgggcccatgcagacaggctgggtctaagagtccacaaggttggccagggcaggtaggatgcacaggaggcatctggatctggaagtacttggacagctgaggtcaagatcacacagaaatttattcctggacagccaaggtttacaggagcagaaatagcaaatattttcttgctccgtctctcccttttttcccagtgcccttttctgtacctacccagatcactttatacctagacatctgtcacaattttgtaactggtcttcgtcc

SEQ ID NO: 418881 - DNA, 3277 bp, Homo sapiens
acaggatccaaaatggcagcgctgtcgccttagctgggagagcgagccgttgtggctgtttgggagacttatggtcaccctgaagtactgcctgcctctagtgtcgcgtccctccagtatccgatgggagcgccgtccgcagggaatgtgtctctctgatcatggtgcctcgtgtccagctctggggaagaccgagacgaaatcgagtcagctggcgttgggagagggcttatttccgcttccgcttgcccactttcaggaatttgattctgagagcagggctgcggttccaggcagggtttgtacacatatttgcgttggaaggagagaggagcctaggacacatatgtattaactgtgcagctggtccgactcccgacagcttcagcgcacaccagccagccttggagttgctggaacggccctggctgcaagctggaatcacccggagagctttcgacattgatgcctgaggcccagctgtggagcgacagtttgaaaagagctgcaggtgactctaatgtgcagctaaagctaggaaccactgagctacatctcagggaagactgaaaattacaaagaatatgataaaatcttacttcaggaacaaagctacgtttttccagcttccccttctcagaatcctgctcttcctccagagagattcccaggagaagagggaacaaccaattcattcctgaaagccaggcctcgggacctgatgacatttgaagatgtggctgtggaattcagccagtgggagtgggggcagctgaaccctgctcagaaggacctctacagggaggtgatgctggagaacttcaggaacttggccattctgggccttctagtatccaaaccatatgtgatctgccagttggaggaagggggtgagcccttcatggtggagagagaaatctcaacaggagcccactcagactggaagagaaggtctaaatccaaggaatcaatgccaagttggggaatttccaaagaagaattattccaggtagtatcagtggaaaaacacattcaagatgtgctgcagttctcgaagttgaaagcagcctgcggttgtgatggccagttagagatgcagcagataaaacaggagagacacctgaaacaaatgtcaaccattcacaaatctgccaccacccttagcagagattataaatggaatggatttgggagaagcttaggtttaagatcagtccttgttaaccaacacagcattctcatgggagaaggatcttataaatgtgatacagaattcaggcagactttagggggaaacaactctcagagaacccacccagaaaagaaatcttgtaaatgtaatgagtgtgggaagtcctttcacttccagtcagaacttaggcgccatcagcgatgtcacactggagaaaagccgtatgaatgcagtgactgtggaagagcctttggtcatatttcatcccttattaaacatcaaagaactcatactggagaaaagccctatgaatgcagtgaatgtgggagagccttcagccagagttcgtctcttgttctgcactatagatttcacactggagagaaaccctacaaatgtaatgaatgtggacgagcctttggtcacacttcatcccttattaagcatcagaggactcatactggagaaaagccctatgaatgccgggaatgtgggagaaccttcagccagagctcatcactcattgtgcattacagatttcatactggagagaaaccttacaaatgtaataaatgtgggagagccttcagccagagttcatctctcactcaacattacagatttcacactggagagaaaccctacaaatgtaatgagtgtggaagggcctttgctcatactgcatcccttattaaacatcagagaagtcatgctggaaaaaaaaccctataaattcagtgaatatagaagggctttcagctggagtgcagacatcactggaacttaaagaattcatatcagagagagatcctaaaggtgtaatgtatgtgggaagaccacatcttgttccacatcaggcaataattactaaagagaatccctgtcaatgtcaagagggggtgggcttcccctctcttaccaaacatgggagaatccatactagtgagaaaccacgtgaatgtaatgaatgtgggaacgctttgatcagaggatgcatattattcagcatcagacagccgacactggggaggagccttatcaatgcagtgagtgtggcaagccttcagttacatactgattctttaagaaaatcagataacttgtactggagagaaatcctacaagtgtggtaagtatggaaaaatcttcagttgtatctcttcctttactaagcatcaagaacacatactagagagaggccctatgaaagcaggaaatagaggaaggccttcagtcagggctcatcccttattaagcatcagaaaattcatacctgagaaaaacctgtgaatgtgggtaatgtgggagagccttcagccaaacctcattgctttataaaccccttagaactctccctactagctggaaactctggtgacgtgatgaatgtgggaagggctttggtggatgttccaccaaaacacgttagagaatttgtacattagagaatttgtgctagagcaactcttcaaatttagtgaaactgggaaaacccattagtagagttcaagcttcagtattcatctcaaagagaaaccttgggaacatgatgaatgtgaggaaagttcctttccaacttgagatgtataaaactagagctgaaaagaagctgagaaatcaccttgtctggtgattttctgcctggtggggccatttgtataacgacacttgtgcattgcctcctcatgctgttactgacggggcagggtgtcatgcatgggtgcagaggatggaggctgagaaaggtagacagctacccatgatctagcccagtcgtattttagagctaataaaactgatgttcagaaagtgacatgccttggcctatagtcctaactgggctgggcctctttcctgtggttcacagctgtagtatggagattaatagactggatctttgcagtacaacacctctatgcacttctttctctgtagcacatgttacctttctttgtgaggcaatggagtggtctaggattgagcaaaaagcaatttttgttacatctttatgctaatagatttggaatttttgaaatgaaatgaaaccttgtttcattttactgaggcggacagatcacgaggtcg

SEQ ID NO: 418882 - DNA, 2361 bp, Homo sapiens
acaggatccaaaatggcagcgctgtcgccttagctgggagagcgagccgttgtggctgtttgggagacttatggtcaccctgaagtactgcctgcctctagtgtcgcgtccctccagtatccgatgggagcgccgtccgcagggaatgtgtctctctgatcatggtgcctcgtgtccagctctggggaagaccgagacgaaatcgagtcagctggcgttgggagagggcttatttccgcttccgcttgcccactttcaggaatttgattctgagagcagggctgcggttccaggcagggtttgtacacatatttgcgttggaaggagagaggagcctaggacacatatgtattaactgtgcagctggtccgactcccgacagcttcagcgcacaccagccagccttggagttgctggaacggccctggctgcaagctggaatcacccggagagctttcgacattgatgcctgaggcccagctgtggagcgacagtttgaaaagagctgcaggtgactctaatgtgcagctaaagctaggaaccactgagctacatctcagggaagactgaaaattacaaagaatatgataaaatcttacttcaggaacaaagctacgtttttccagcttccccttctcagaatcctgctcttcctccagagagattcccaggagaagagggaacaaccaattcattcctgaaagccaggcctcgggacctgatgacatttgaagatgtggctgtggaattcagccagtgggagtgggggcagctgaaccctgctcagaaggacctctacagggaggtgatgctggagaacttcaggaacttggccattctgggccttctagtatccaaaccatatgtgatctgccagttggaggaagggggtgagcccttcatggtggagagagaaatctcaacaggagcccactcagactggaagagaaggtctaaatccaaggaatcaatgccaagttggggaatttccaaagaagaattattccaggtagtatcagtggaaaaacacattcaagatgtgctgcagttctcgaagttgaaagcagcctgcggttgtgatggccagttagagatgcagcagataaaacaggagagacacctgaaacaaatgtcaaccattcacaaatctgccaccacccttagcagagattataaatggaatggatttgggagaagcttaggtttaagatcagtccttgttaaccaacacagcattctcatgggagaaggatcttataaatgtgatacagaattcaggcagactttagggggaaacaactctcagagaacccacccagaaaagaaatcttgtaaatgtaatgagtgtgggaagtcctttcacttccagtcagaacttaggcgccatcagcgatgtcacactggagaaaagccgtatgaatgcagtgactgtggaagagcctttggtcatatttcatcccttattaaacatcaaagaactcatactggagaaaagccctatgaatgcagtgaatgtgggagagccttcagccagagttcgtctcttgttctgcactatagatttcacactggagagaaaccctacaaatgtaatgaatgtggacgagcctttggtcacacttcatcccttattaagcatcagaggactcatactggagaaaagccctatgaatgccgggaatgtgggagaaccttcagccagagctcatcactcattgtgcattacagatttcatactggagagaaaccttacaaatgtaataaatgtgggagagccttcagccagagttcatctctcactcaacattacagatttcacactggagagaaaccctacaaatgtaatgagtgtggaagggcctttgctcatactgcatcccttattaaacatcagagaagtcatgctggaaaaaaaaccctataaattcagtgaatatagaagggctttcagctggagtgcagacatcactggaacttaaagaattcatatcagagagagatcctaaaggtgtaatgtatgtgggaagaccacatcttgttccacatcaggcaataattactaaagagaatccctgtcaatgtcaagagggggtgggcttcccctctcttaccaaacatgggagaatccatactagtgagaaaccacgtgaatgtaatgaatgtgggaacgctttgatcagaggatgcatattattcagcatcagacagccgacactggggaggagccttatcaatgcagtgagtgtggcaagccttcagttacatactgattctttaagaaaatcagataacttgtactggagagaaatcctacaagtgtgagtctggaggcttgaccatagaccagcaaagaccccaaaa

SEQ ID NO: 418883 - DNA, 861 bp, Homo sapiens
ggctctgcctctgcaggatgaggcctggcccagtagagcaatgcttgagacagggtaaatctgtccagttctagagttcagtgataagaagcttactggccttaagatgaaacccatattctcttgctgagcacagtggcacacatctatagtcctagctgcttgggaggctgcggcagcaggattgcttgagccaaggagttcatcaaggctaaagtgtaccatgatcatacctataaatagtcactgcactccagcctggcaacacatgagaccctgtctcctaaaaaaaaacttctccaatagttttatcagcaaataaaggtgttttttaggcctctatattagtttattcattcttcatcttagttatattcacaacccagaatggaaaggaggtatgccatttattggaccttctcaagccccaacaaataaatatacttattcccaggttatacagccactaaatattaaatagatctgcgttctttctcattgtaggggtttagcaaacaaagtgctttgtatccaataacagaagaatagaaatatgcataccataccctgtccccattacttttagatcctatatcctttccatgaaacttcattttgatggtggttctggggttcaggtaaatttttgtttcagtgatggaaatatatgaaataaggatgagaggattgtgtttctatatgccttaaaactatacctctattccagcacttgcacttcactatgaaacagcaattatacgtatctttttcctacactaaactacaagttctcagaaggcctctagacacatgtgaggtacttgttaaacgcctgtggaataaatgatactcataaatctc

SEQ ID NO: 418884 - DNA, 147 bp, Homo sapiens
  misc_feature (1)..(1): n is a, c, g, or t
  misc_feature (3)..(3): n is a, c, g, or t
  misc_feature (5)..(7): n is a, c, g, or t
  misc_feature (10)..(10): n is a, c, g, or t
  misc_feature (13)..(13): n is a, c, g, or t
  misc_feature (15)..(16): n is a, c, g, or t
  misc_feature (140)..(141): n is a, c, g, or t
  misc_feature (143)..(143): n is a, c, g, or t
  misc_feature (145)..(145): n is a, c, g, or t
ncntnnnaantanannagacttggaactggagatgagaacagaatattatcttcctcatttttgtgtttttgttcaactctaatgtctgcaaagcacttgcgtatgtaatgatgctcagtgtcataggagcaggcagganntntnaa

SEQ ID NO: 418885 - DNA, 2475 bp, Homo sapiens
gcgtggcgaaggtcgctgctttcctgctacaacgggcctactttagctaaaacagaaacgtaaggccaggacgggtcaccctttgtgggcccctgaaaaatacaaaacgaagtttggagagagttgaaaggcgtttgggctgaccatggagatttttgtttcccaccctcctgcgaaagcgttcgcgctgccattggctctggctgagggcgagtccggaacctgtgcgccgcggaactttcggctctgaaatccaacttgcgctgggcgcatctttgccgcgcggtttccgggcggctcccttcccttgcatgctgcattgtgtcgggagttgctgacagccatggcgccgcaggtctggcgtcgacggaccctggagcggtgtctgacggaagtcggcaaagccacgggtcggcccgagtgcttcctcacgattcaagagggattggcatcaaagttcacttctttaacaaaagtgctttatgactttaataaaatattagagaatggtaggatccatggaagccccttgcaaaaacttgtgatagcaaattttgatgatgagcagatttggcaacaactggaattgcaaaatgaaccaattttacaatactttcagaatgcagttagtgaaacaattaatgatgaagatatcagtcttctcccagagagtgaagaacaggaacgtgaagaggatggttcagagatagaggctgatgacaaggaggacctagaagatttagaggaggaggaagtgtccgacatgggtaatgatgatcctgaaatgggtgagagagctgaaaactcaagcaaatctgatctgaggaaaagccccgttttcagtgatgaggattctgaccttgactttgatatcagcaaattggaacagcagagcaaggtgcaaaacaaaggacagggaaaaccaagagaaaagtccatagtagatgataaattcttcaaactctctgaaatggaggcctatttagaaaacatagaaaaagaagaggaacgaaaagatgataatgatgaggaggaggaagatattgatttttttgaagatattgattctgatgaagatgaagggggactgtttggaagtaaaaaacttaagtcaggtaaaagttccagaaatctgaaatacaaagatttttttgatccagttgaaagtgatgaagacataacaaatgttcatgatgatgagctggattcaaacaaagaagatgatgaaattgctgaagaagaagcagaagaactaagtatttcggaaacggatgaagatgatgaccttcaagaaaatgaagacaataaacaacataaagaaagcttgaaaagagtgacctttgctttaccagatgatgcggaaactgaagatacaggtgttttaaatgtaaagaaaaattctgatgaagttaaatcctcctttgaaaaaagacaggaaaagatgaatgaaaaaattgcatctttagaaaaagagttgttagaaaaaaagccgtggcagcttcagggggaagtgacagcacagaagaggccagagaacagcctcctggaggagaccctacactttgaccatgctgtccggatggcacctgtgattacagaggaaaccacccttcaactggaagatatcattaaacagaggataagagatcaggcttgggatgatgtagtacgtaaagaaaaacctaaagaggatgcatatgaatataaaaagcgtttaaccttagaccatgagaagagtaaattgagccttgctgaaatttatgaacaggagtacatcaaactcaaccagcaaaaaacagcagaagaagaaaatccagaacatgtagaaattcagaagatgatggattccctcttcttaaaattggatgccctctcaaacttccactttatccctaaaccgcctgtaccagagattaaagttgtgtcaaatctgccagccataaccatggaggaagtagccccagtgagtgttagtgatgcagctctcctggccccagaggagatcaaggagaaaaataaagctggagatataaaaacagctgctgaaaaaacagctacagacaagaaacgagagcgaaggaaaaagaaatatcaaaagcgtatgaaaataaaagagaaggagaagcggagaaaactgcttgaaaagagcagtgtagatcaagcagggaaatacagcaaaacagtagcttcggagaagttaaaacagctgaccaaaactggcaaagcttccttcataaaggatgaaggtaaagacaaggccttaaagtcctctcaagcattcttttctaaattacaagatcaagtaaaaatgcaaatcaatgatgcaaagaaaacagaaaagaaaaagaagaaaagacaggatatttctgttcataaattaaagctgtaatatattttgaatataatgtaaatattaatgtgtaagcttatattgtgtcattgttctgttttataataaaattcttgagaaccttc

SEQ ID NO: 418886 - DNA, 2329 bp, Homo sapiens
gcgtggcgaaggtcgctgctttcctgctacaacgggcctactttagctaaaacagaaacgtaaggccaggacgggtcaccctttgtgggcccctgaaaaatacaaaacgaagtttggagagagttgaaaggcgtttgggctgaccatggagatttttgtttcccaccctcctgcgaaagcgttcgcgctgccattggctctggctgagggcgagtccggaacctgtgcgccgcggaactttcggctctgaaatccaacttgcgctgggcgcatctttgccgcgcggtttccgggcggctcccttcccttgcatgctgcattgtgtcgggagttgctgacagccatggcgccgcaggtctggcgtcgacggaccctggagcggtgtctgacggaagtcggcaaagccacgggtcggcccgagtgcttcctcacgattcaagagggattggcatcaaagttcacttctttaacaaaagtgctttatgactttaataaaatattagagaatggtaggatccatggaagccccttgcaaaaacttgtgatagcaaattttgatgatgagcagatttggcaacaactggaattgcaaaatgaaccaattttacaatactttcagaatgcagttagtgaaacaattaatgatgaagatatcagtcttctcccagagagtgaagaacaggaacgtgaagaggatggttcagagatagaggctgatgacaaggaggacctagaagatttagaggaggaggaagtgtccgacatgggtaatgatgatcctgaaatgggtgagagagctgaaaactcaagcaaatctgatctgaggaaaagccccgttttcagtgatgaggattctgaccttgactttgatatcagcaaattggaacagcagagcaaggtgcaaaacaaaggacagggaaaaccaagagaaaagtccatagtagatgataaattcttcaaactctctgaaatggaggcctatttagaaaacatagaaaaagaagaggaacgaaaagatgataatgatgaggaggaggaagatattgatttttttgaagatattgattctgatgaagatgaagggggactgtttggaagtaaaaaacttaagtcaggtaaaagttccagaaatctgaaatacaaagatttttttgatccagttgaaagtgatgaagacataacaaatgttcatgatgatgagctggattcaaacaaagaagatgatgaaattgctgaagaagaagcagaagaactaagtatttcggaaacggatgaagatgatgaccttcaagaaaatgaagacaataaacaacataaagaaagcttgaaaagagtgacctttgctttaccagatgatgcggaaactgaagatacaggtgttttaaatgtaaagaaaaattctgatgaagttaaatcctcctttgaaaaaagacaggaaaagatgaatgaaaaaattgcatctttagaaaaagagttgttagaaaaaaagccgtggcagcttcagggggaagtgacagcacagaagaggccagagaacagcctcctggaggagaccctacactttgaccatgctgtccggatggcacctgtgattacagaggaaaccacccttcaactggaagatatcattaaacagaggataagagatcaggcttgggatgatgtagtacgtaaagaaaaacctaaagaggatgcatatgaatataaaaagcgtttaaccttagaccatgagaagagtaaattgagccttgctgaaatttatgaacaggagtacatcaaactcaaccagcaaaaaacagcagaagaagaaaatccagaacatgtagaaattcagaagatgatggattccctcttcttaaaattggatgccctctcaaacttccactttatccctaaaccgcctgtaccagagattaaagttgtgtcaaatctgccagccataaccatggaggaagtagccccagtgagtgttagtgatgcagctctcctggccccagaggagatcaaggagaaaaataaagctggagatataaaaacagctgctgaaaaaacagctacagacaagaaacgagagcgaaggaaaaagaaatatcaaaagcgtatgaaaataaaagagaaggagaagcggagaaaactgcttgaaaagagcagtgtagatcaagcagggaaatacagcaaaacagtagcttcggagaagttaaaacagctgaccaaaactggcaaagcttccttcataaaggatgaaggtaaagacaaggccttaaagtcctctcaagcattcttttctaaattacaagatcaagtaaaaatgcaaatcaatgatgcaaag

SEQ ID NO: 418887 - DNA, 946 bp, Homo sapiens
gtaaataccaaggtaattaaatttttaagttctgagtattagaggtaatggttactgtagctcctaaaatgcacatcacatctctggtaggtgctggaaccctcatggtactgctgcttttaattttgcttttggaatgtttctttgtagctgaagctttagtgatgagaagttagaaatactctcattgacctttagtgttttgtcctgtgatatatatcaagtcgcttagtttgacattgttgaacttatttcctaagcaaaaaacagcagaagaagaaaatccagaacatgtagaaattcagaagatgatggattccctcttcttaaaattggatgccctctcaaacttccactttatccctaaaccgcctgtaccagagattaaagttgtgtcaaatctgccagccataaccatggaggaagtagccccagtgagtgttagtgatgcagctctcctggccccagaggagatcaaggagaaaaataaagctggagatataaaaacagctgctgaaaaaacagctacagacaagaaacgagagcgaaggaaaaagaaatatcaaaagcgtatgaaaataaaagagaaggagaagcggagaaaactgcttgaaaagagcagtgtagatcaagcagggaaatacagcaaaacagtagcttcggagaagttaaaacagctgaccaaaactggcaaagcttccttcataaaggatgaaggtaaagacaaggccttaaagtcctctcaagcattcttttctaaattacaagatcaagtaaaaatgcaaatcaatgatgcaaagaaaacagaaaagaaaaagaagaaaagacaggatatttctgttcataaattaaagctgtaatatattttgaatataatgtaaatattaatgtgtaagcttatattgtgtcattgttctgttttataataaaattcttgagaaccttc

SEQ ID NO: 418888 - DNA, 2741 bp, Homo sapiens
gcgtggcgaaggtcgctgctttcctgctacaacgggcctactttagctaaaacagaaacgtaaggccaggacgggtcaccctttgtgggcccctgaaaaatacaaaacgaagtttggagagagttgaaaggcgtttgggctgaccatggagatttttgtttcccaccctcctgcgaaagcgttcgcgctgccattggctctggctgagggcgagtccggaacctgtgcgccgcggaactttcggctctgaaatccaacttgcgctgggcgcatctttgccgcgcggtttccgggcggctcccttcccttgcatgctgcattgtgtcgggagttgctgacagccatggcgccgcaggtctggcgtcgacggaccctggagcggtgtctgacggaagtcggcaaagccacgggtcggcccgagtgcttcctcacgattcaagagggattggcatcaaagttcacttctttaacaaaagtgctttatgactttaataaaatattagagaatggtaggatccatggaagccccttgcaaaaacttgtgatagcaaattttgatgatgagcagatttggcaacaactggaattgcaaaatgaaccaattttacaatactttcagaatgcagttagtgaaacaattaatgatgaagatatcagtcttctcccagagagtgaagaacaggaacgtgaagaggatggttcagagatagaggctgatgacaaggaggacctagaagatttagaggaggaggaagtgtccgacatgggtaatgatgatcctgaaatgggtgagagagctgaaaactcaagcaaatctgatctgaggaaaagccccgttttcagtgatgaggattctgaccttgactttgatatcagcaaattggaacagcagagcaaggtgcaaaacaaaggacagggaaaaccaagagaaaagtccatagtagatgataaattcttcaaactctctgaaatggaggcctatttagaaaacatagaaaaagaagaggaacgaaaagatgataatgatgaggaggaggaagatattgatttttttgaagatattgattctgatgaagatgaagggggactgtttggaagtaaaaaacttaagtcaggtaaaagttccagaaatctgaaatacaaagatttttttgatccagttgaaagtgatgaagacataacaaatgttcatgatgatgagctggattcaaacaaagaagatgatgaaattgctgaagaagaagcagaagaactaagtatttcggaaacggatgaagatgatgaccttcaagaaaatgaagacaataaacaacataaagaaagcttgaaaagagtgacctttgctttaccagatgatgcggaaactgaagatacaggtgttttaaatgtaaagaaaaattctgatgaagttaaatcctcctttgaaaaaagacaggaaaagatgaatgaaaaaattgcatctttagaaaaagagttgttagaaaaaaagccgtggcagcttcagggggaagtgacagcacagaagaggccagagaacagcctcctggaggagaccctacactttgaccatgctgtccggatggcacctgtgattacagaggaaaccacccttcaactggaagatatcattaaacagaggataagagatcaggcttgggatgatgtagtacgtaaagaaaaacctaaagaggatgcatatgaatataaaaagcgtttaaccttagaccatgagaagagtaaattgagccttgctgaaatttatgaacaggagtacatcaaactcaaccagcaaaaaacagcagaagaagaaaatccagaacatgtagaaattcagaagatgatggattccctcttcttaaaattggatgccctctcaaacttccactttatccctaaaccgcctgtaccagagattaaagttgtgtcaaatctgccagccataaccatggaggaagtagccccagtgagtgttagtgatgcagctctcctggccccagaggagatcaaggagaaaaataaagctggagatataaaaacagctgctgaaaaaacagctacagacaagaaacgagagcgaaggaaaaagaaatatcaaaagcgtatgaaaataaaagagaaggagaagcggagaaaactgcttgaaaagagcagtgtagatcaagcagggaaatacagcaaaacagtagcttcggagaagttaaaacagctgaccaaaactggcaaagcttccttcataaaggtaaggacaagggaaagaaaactgctcaaggggacctttgtgggggaagtggatagcaagtgctgggtgactggaatgtctgagccagctgacagcccacctgcgggatagagatgcatgatgctgactggctggaatcgcaacctttaatgttctagaatttttcatgtagggtcctcacaataacctgggtcctggcagcagcttgtcttccactcctttctctcttagattataagaacattgtagcagtgcagaatacctctatgctaactgattcagttttctgtaattctagtcctttttcatatttatggttgcatacattgttgtaatggtgatgtactatttttggcttttttcacttataagtacattttacagcataagcatgtggtgtttttaattgcaggatgaaggtaaagacaaggccttaaagtcctctcaagcattcttttctaaattacaagatcaagtaaaaatgcaaatcaatgatgcaaag

SEQ ID NO: 418889 - DNA, 1880 bp, Homo sapiens
gcgtggcgaaggtcgctgctttcctgctacaacgggcctactttagctaaaacagaaacgtaaggccaggacgggtcaccctttgtgggcccctgaaaaatacaaaacgaagtttggagagagttgaaaggcgtttgggctgaccatggagatttttgtttcccaccctcctgcgaaagcgttcgcgctgccattggctctggctgagggcgagtccggaacctgtgcgccgcggaactttcggctctgaaatccaacttgcgctgggcgcatctttgccgcgcggtttccgggcggctcccttcccttgcatgctgcattgtgtcgggagttgctgacagccatggcgccgcaggtctggcgtcgacggaccctggagcggtgtctgacggaagtcggcaaagccacgggtcggcccgagtgcttcctcacgattcaagagggattggcatcaaagttcacttctttaacaaaagtgctttatgactttaataaaatattagagaatggtaggatccatggaagccccttgcaaaaacttgtgatagcaaattttgatgatgagcagatttggcaacaactggaattgcaaaatgaaccaattttacaatactttcagaatgcagttagtgaaacaattaatgatgaagatatcagtcttctcccagagagtgaagaacaggaacgtgaagaggatggttcagagatagaggctgatgacaaggaggacctagaagatttagaggaggaggaagtgtccgacatgggtaatgatgatcctgaaatgggtgagagagctgaaaactcaagcaaatctgatctgaggaaaagccccgttttcagtgatgaggattctgaccttgactttgatatcagcaaattggaacagcagagcaaggtgcaaaacaaaggacagggaaaaccaagagaaaagtccatagtagatgataaattcttcaaactctctgaaatggaggcctatttagaaaacatagaaaaagaagaggaacgaaaagatgataatgatgaggaggaggaagatattgatttttttgaagatattgattctgatgaagatgaagggggactgtttggaagtaaaaaacttaagtcaggtaaaagttccagaaatctgaaatacaaagatttttttgatccagttgaaagtgatgaagacataacaaatgttcatgatgatgagctggattcaaacaaagaagatgatgaaattgctgaagaagaagcagaagaactaagtatttcggaaacggatgaagatgatgaccttcaagaaaatgaagacaataaacaacataaagaaagcttgaaaagagtgacctttgctttaccagatgatgcggaaactgaagatacaggtgttttaaatgtaaagaaaaattctgatgaagttaaatcctcctttgaaaaaagacaggaaaagatgaatgaaaaaattgcatctttagaaaaagagttgttagaaaaaaagccgtggcagcttcagggggaagtgacagcacagaagaggccagagaacagcctcctggaggagaccctacactttgaccatgctgtccggatggcacctgtgatactcacattccttgaagctatgagcatttaaaaactgtttacagccaccatagggattcaaaagaatttggaataaactttgaagttttggattttacttatttttatccccaaattgttgctattttttaggatctgaaacaaaatctttctaaaacattgttttagttgtcaaagcaccaacaggacattttgggatgtgaaatgtaatttcttggaatctgtaatttgtacttaatatttcaggcttgtatttaatataataaataggtgtttgtaattgtgtc

SEQ ID NO: 418890 - DNA, 204 bp, Homo sapiens
ggaagtcatcgacagaataaaaagatggcaagaacagaatcgtagaacagtacgtttcttgctttcccactttttaaattattttttgcttttacacaaatataagattttattttctaaatgtatactagttattttatctctttcttagatgaatgaatgaaaaaattgcatctttagaaaaagagttgttagaaaaaaagc

SEQ ID NO: 418891 - DNA, 955 bp, Homo sapiens
taagcttgatatcgaattcggcacgagaggagaccctacactttgaccatgctgtccggatggcacctgtgattacagaggaaaccacccttcaactggaagatatcattaaacagaggataagagatcaggcttgggatgatgtagtacgtaaagaaaaacctaaagaggatgcatatgaatataaaaagcgtttaaccttagaccatgagaagagtaaattgagccttgctgaaatttatgaacaggagtacatcaaactcaaccagcaaaaaacagcagaagaagaaaatccagaacatgtagaaattcagaagatgatggattccctcttcttaaaattggatgccctctcaaacttccactttatccctaaaccgcctgtaccagagattaaagttgtgtcaaatctgccagccataaccatggaggaagtagccccagtgagtgttagtgatgcagctctcctggccccagaggagatcaaggagaaaaataaagctggagatataaaaacagctgctgaaaaaacagctacagacaagaaacgagagcgaaggaaaaagaaatatcaaaagcgtatgaaaataaaagagaaggagaagcggagaaaactgcttgaaaagagcagtgtagatcaagcagggaaatacagcaaaacagtagcttcggagaagttaaaacagctgaccaaaactggcaaagcttccttcataaaggatgaaggtaaagacaaggccttaaagtcctctcaagcattcttttctaaattacaagatcaagtaaaaatgcaaatcaatgatgcaaagaaaacagaaaagaaaaagaagaaaagacaggatatttctgttcataaattaaagctgtaatatattttgaatataatgtaaatattaatgtgtaagcttatattgtgtcattgttctgttttataataaaattcttgagaaccttc

SEQ ID NO: 418892 - DNA, 1209 bp, Homo sapiens
  misc_feature (295)..(295): n is a, c, g, or t
tcgaattcgacggtttctcgacagggggtgattctgtcccccagggaacacgttttagtctcacgactggtggagggtgctcctggcatctagtgagtacaggacagagatgctgctaaacatcctgcagtgtccagaacagccccctacaataaagaattatttgttccaatagggtcaatgtccacagtgctgaacaaagtggagaaaccctggtctaatctaacttttagtacatacaatggaggaagtggttgtcccaagaaggaaagtggcttccctgaggtcacacagngagtcagaggtagattgtgcaagttaaggccatgctttctcttagttcattgaaagaccattgtgccctgggctttatcatgcagcaggagcttgggatgatgtagtacgtaaagaaaaacctaaagaggatgcatatgaatataaaaagcgtttaaccttagaccatgagaagagtaaattgagccttgctgaaatttatgaacaggagtacatcaaactcaaccagcaaaaaacagcagaagaagaaaatccagaacatgtagaaattcagaagatgatggattccctcttcttaaaattggatgccctctcaaacttccactttatccctaaaccgcctgtaccagagattaaagttgtgtcaaatctgccagccataaccatggaggaagtagccccagtgagtgttagtgatgcagctctcctggccccagaggagatcaaggagaaaaataaagctggagatataaaaacagctgctgaaaaaacagctacagacaagaaacgagagcgaaggaaaaagaaatatcaaaagcgtatgaaaataaaagagaaggagaagcggagaaaactgcttgaaaagagcagtgtagatcaagcagggaaatacagcaaaacagtagcttcggagaagttaaaacagctgaccaaaactggcaaagcttccttcataaaggatgaaggtaaagacaaggccttaaagtcctctcaagcattcttttctaaattacaagatcaagtaaaaatgcaaatcaatgatgcaaagaaaacagaaaagaaaaagaagaaaagacaggatatttctgttcataaattaaagctgtaatatattttgaatataatgtaaatattaatgtgtaagcttatattgtgtcattgttctgttttataataaaattcttgagaaccttc

SEQ ID NO: 418893 - DNA, 2436 bp, Homo sapiens
gcgtggcgaaggtcgctgctttcctgctacaacgggcctactttagctaaaacagaaacgtaaggccaggacgggtcaccctttgtgggcccctgaaaaatacaaaacgaagtttggagagagttgaaaggcgtttgggctgaccatggagatttttgtttcccaccctcctgcgaaagcgttcgcgctgccattggctctggctgagggcgagtccggaacctgtgcgccgcggaactttcggctctgaaatccaacttgcgctgggcgcatctttgccgcgcggtttccgggcggctcccttcccttgcatgctgcattgtgtcgggagttgctgacagccatggcgccgcaggtctggcgtcgacggaccctggagcggtgtctgacggaagtcggcaaagccacgggtcggcccgagtgcttcctcacgattcaagagggattggcatcaaagttcacttctttaacaaaagtgctttatgactttaataaaatattagagaatggtaggatccatggaagccccttgcaaaaacttgtgatagcaaattttgatgatgagcagatttggcaacaactggaattgcaaaatgaaccaattttacaatactttcagaatgcagttagtgaaacaattaatgatgaagatatcagtcttctcccagagagtgaagaacaggaacgtgaagaggatggttcagagatagaggctgatgacaaggaggacctagaagatttagaggaggaggaagtgtccgacatgggtaatgatgatcctgaaatgggtgagagagctgaaaactcaagcaaatctgatctgaggaaaagccccgttttcagtgatgaggattctgaccttgactttgatatcagcaaattggaacagcagagcaaggtgcaaaacaaaggacagggaaaaccaagagaaaagtccatagtagatgataaattcttcaaactctctgaaatggaggcctatttagaaaacatagaaaaagaagaggaacgaaaagatgataatgatgaggaggaggaagatattgatttttttgaagatattgattctgatgaagatgaagggggactgtttggaagtaaaaaacttaagtcaggtaaaagttccagaaatctgaaatacaaagatttttttgatccagttgaaagtgatgaagacataacaaatgttcatgatgatgagctggattcaaacaaagaagatgatgaaattgctgaagaagaagcagaagaactaagtatttcggaaacggatgaagatgatgaccttcaagaaaatgaagacaataaacaacataaagaaagcttgaaaagagtgacctttgctttaccagatgatgcggaaactgaagatacaggtgttttaaatgtaaagaaaaattctgatgaagttaaatcctcctttgaaaaaagacaggaaaagatgaatgaaaaaattgcatctttagaaaaagagttgttagaaaaaaagccgtggcagcttcagggggaagtgacagcacagaagaggccagagaacagcctcctggaggagaccctacactttgaccatgctgtccggatggcacctgtgattacagaggaaaccacccttcaactggaagatatcattaaacagaggataagagatcaggcttgggatgatgtagtacgtaaagaaaaacctaaagaggatgcatatgaatataaaaagcgtttaaccttagaccatgagaagagtaaattgagccttgctgaaatttatgaacaggagtacatcaaactcaaccagcaaaaaacagcagaagaagaaaatccagaacatgtagaaattcagaagatgatggattccctcttcttaaaattggatgccctctcaaacttccactttatccctaaaccgcctgtaccagagattaaagttgtgtcaaatctgccagccataaccatggaggaagtagccccagtgagtgagaaaaataaagctggagatataaaaacagctgctgaaaaaacagctacagacaagaaacgagagcgaaggaaaaagaaatatcaaaagcgtatgaaaataaaagagaaggagaagcggagaaaactgcttgaaaagagcagtgtagatcaagcagggaaatacagcaaaacagtagcttcggagaagttaaaacagctgaccaaaactggcaaagcttccttcataaaggatgaaggtaaagacaaggccttaaagtcctctcaagcattcttttctaaattacaagatcaagtaaaaatgcaaatcaatgatgcaaagaaaacagaaaagaaaaagaagaaaagacaggatatttctgttcataaattaaagctgtaatatattttgaatataatgtaaatattaatgtgtaagcttatattgtgtcattgttctgttttataataaaattcttgagaaccttc

SEQ ID NO: 418894 - DNA, 2887 bp, Homo sapiens
gcgtggcgaaggtcgctgctttcctgctacaacgggcctactttagctaaaacagaaacgtaaggccaggacgggtcaccctttgtgggcccctgaaaaatacaaaacgaagtttggagagagttgaaaggcgtttgggctgaccatggagatttttgtttcccaccctcctgcgaaagcgttcgcgctgccattggctctggctgagggcgagtccggaacctgtgcgccgcggaactttcggctctgaaatccaacttgcgctgggcgcatctttgccgcgcggtttccgggcggctcccttcccttgcatgctgcattgtgtcgggagttgctgacagccatggcgccgcaggtctggcgtcgacggaccctggagcggtgtctgacggaagtcggcaaagccacgggtcggcccgagtgcttcctcacgattcaagagggattggcatcaaagttcacttctttaacaaaagtgctttatgactttaataaaatattagagaatggtaggatccatggaagccccttgcaaaaacttgtgatagcaaattttgatgatgagcagatttggcaacaactggaattgcaaaatgaaccaattttacaatactttcagaatgcagttagtgaaacaattaatgatgaagatatcagtcttctcccagagagtgaagaacaggaacgtgaagaggatggttcagagatagaggctgatgacaaggaggacctagaagatttagaggaggaggaagtgtccgacatgggtaatgatgatcctgaaatgggtgagagagctgaaaactcaagcaaatctgatctgaggaaaagccccgttttcagtgatgaggattctgaccttgactttgatatcagcaaattggaacagcagagcaaggtgcaaaacaaaggacagggaaaaccaagagaaaagtccatagtagatgataaattcttcaaactctctgaaatggaggcctatttagaaaacatagaaaaagaagaggaacgaaaagatgataatgatgaggaggaggaagatattgatttttttgaagatattgattctgatgaagatgaagggggactgtttggaagtaaaaaacttaagtcaggtaaaagttccagaaatctgaaatacaaagatttttttgatccagttgaaagtgatgaagacataacaaatgttcatgatgatgagctggattcaaacaaagaagatgatgaaattgctgaagaagaagcagaagaactaagtatttcggaaacggatgaagatgatgaccttcaagaaaatgaagacaataaacaacataaagaaagcttgaaaagagtgacctttgctttaccagatgatgcggaaactgaagatacaggtgttttaaatgtaaagaaaaattctgatgaagttaaatcctcctttgaaaaaagacaggaaaagatgaatgaaaaaattgcatctttagaaaaagagttgttagaaaaaaagccgtggcagcttcagggggaagtgacagcacagaagaggccagagaacagcctcctggaggagaccctacactttgaccatgctgtccggatggcacctgtgattacagaggaaaccacccttcaactggaagatatcattaaacagaggataagagatcaggcttgggatgatgtagtacgtaaagaaaaacctaaagaggatgcatatgaatataaaaagcgtttaaccttagaccatgagaagagtaaattgagccttgctgaaatttatgaacaggagtacatcaaactcaaccagcaaaaaacagcagaagaagaaaatccagaacatgtagaaattcagaagatgatggattccctcttcttaaaattggatgccctctcaaacttccactttatccctaaaccgcctgtaccagagattaaagttgtgtcaaatctgccagccataaccatggaggaagtagccccagtgagtgttagtgatgcagctctcctggccccagaggagatcaaggagaaaaataaagctggagatataaaaacagctgctgaaaaaacagctacagacaagaaacgagagcgaaggaaaaagaaatatcaaaagcgtatgaaaataaaagagaaggagaagcggagaaaactgcttgaaaagagcagtgtagatcaagcagggaaatacagcaaaacagtagcttcggagaagttaaaacagctgaccaaaactggcaaagcttccttcataaaggtaaggacaagggaaagaaaactgctcaaggggacctttgtgggggaagtggatagcaagtgctgggtgactggaatgtctgagccagctgacagcccacctgcgggatagagatgcatgatgctgactggctggaatcgcaacctttaatgttctagaatttttcatgtagggtcctcacaataacctgggtcctggcagcagcttgtcttccactcctttctctcttagattataagaacattgtagcagtgcagaatacctctatgctaactgattcagttttctgtaattctagtcctttttcatatttatggttgcatacattgttgtaatggtgatgtactatttttggcttttttcacttataagtacattttacagcataagcatgtggtgtttttaattgcaggatgaaggtaaagacaaggccttaaagtcctctcaagcattcttttctaaattacaagatcaagtaaaaatgcaaatcaatgatgcaaagaaaacagaaaagaaaaagaagaaaagacaggatatttctgttcataaattaaagctgtaatatattttgaatataatgtaaatattaatgtgtaagcttatattgtgtcattgttctgttttataataaaattcttgagaaccttc

SEQ ID NO: 418895 - DNA, 867 bp, Homo sapiens
tagttatttcactttcttccgcagcaaggatgcatggtaaatgcctagcacataacaggttctccattaatgagagttgttagtgttattgagtgcaaaactcagcttggagcttctagcagccaagaccaaaagggaggagttggtcacatcttggccccctcctccaccccccagtccagcattcttttccttgcctgctgctcaatctttggctgcttcatgagtaccccatccccaccatgtacaagctcttctgtgggctaagctgcctggggtgggcctgactataatccccctctgctcctccaccaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggtaccctggatcccctcccctgctcctgcaccagtgatgggctctgcccggtggcacctcaaagtcaggtaccccagggatgcagcctccagggcccatctgcatggaggaaggcagtgttttctgaccagggctcattcacccaacgggggtctataattagcacctggttcaagtcagcccctatgtgacaggcactggggatttggaggcgagcaagaaacttcccacaccagctctccacgtattcccctggtgccaggttctccaccctctgtgtctttgaagttgctgttccctctaccttagactgaaggtgaactccaatatccccttcaattctgagcctaaataccaaggtccttgggcagaaggggtcctcccttcccgccc

SEQ ID NO: 418896 - DNA, 1463 bp, Homo sapiens
acccaagaagtgtctctgtaggagggaggggtatgggtacagagagtgccccggacccctttggccctcactgtcaccccttcctgaatggcaggtgatggatctcggccgcgacgccacccgccgcttcttcaactggttttactggagcatcaacctgggtgctgtgctgtcgctgctggtggtggcgtttattcagcagattggggaggtcctgtacaacgcggcaccactgtccatctggtggcagatccctcagtacctgctcattgggatcagtgagatctttgccagcatcccaggcctggagtttgcctactcagaggccccgcgctccatgcaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacgatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcacga

SEQ ID NO: 418897 - DNA, 2695 bp, Homo sapiens
ggagttgagaattagggaggaggtggtagagtccgggtagtgagcggagggacaggaagggtagggcaagaaagggagaggggacaggagggaagggtgggccaaagcggtgagaaaggagggccagccagttgggtgggggagagggccgaggcccgggggcaggagtgcagggctctgaggcggggagaggagaggagagaagagccgcggggggcccagcccggagccaggatgcccgcgccgcgcgcccgggagcagccccgcgtgcccggggagcgccagccgctgctgcctcgcggtgcgcggggccctcgacggtggcggcgggcggcgggcgcggccgtgctgctggtggagatgctggagcgcgccgccttcttcggcgtcaccgccaacctcgtgctgtacctcaacagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacgatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcacgaccatggtccatgacaaggggcagggcagagggggcctggatgggagtccttgtgggggaccaggcaggggacttggatcaacaagcaccagacgagtggcgggggcaggcgagaggctcagtgggacctccaccctcgttgccccagctggtggctgaccaggtggctgtggagggtcaggagctgccccggatcctctccatgtagttgcgaagctcctcagggtccttcagccccatgtcctcacacacccagcggatgtcctcctcgcctgccacaaggatggactgcacagcaggggcccctacaggctcctcaggtgactgggctggaggggctggcacaaatgtcacaaactctactcgcttccgccgccccccagcctcctttcgggccagggtgcttgaggagctggtggtgcccccaggagggccaggggccaggtaggggcctcccctctctcccccatctcacaggggcagttcccctcccccttgggcgggccaggggactgccggtccagctggcggctcagttcctcctggtcagtgcccagccagacccagttgtggggctgggg

SEQ ID NO: 418898 - DNA, 2166 bp, Homo sapiens
ggagttgagaattagggaggaggtggtagagtccgggtagtgagcggagggacaggaagggtagggcaagaaagggagaggggacaggagggaagggtgggccaaagcggtgagaaaggagggccagccagttgggtgggggagagggccgaggcccgggggcaggagtgcagggctctgaggcggggagaggagaggagagaagagccgcggggggcccagcccggagccaggatgcccgcgccgcgcgcccgggagcagccccgcgtgcccggggagcgccagccgctgctgcctcgcggtgcgcggggccctcgacggtggcggcgggcggcgggcgcggccgtgctgctggtggagatgctggagcgcgccgccttcttcggcgtcaccgccaacctcgtgctgtacctcaacagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacgatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgctgaagaggaattgtagacacccctggagatcttcaggaagtcaaacattaggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcacga

SEQ ID NO: 418899 - DNA, 600 bp, Homo sapiens
ggggcagggtcaggggcagcaagcaggggcctgggcctgttctctgcgcctgcaccagcccctgagatcgtctctgctccccctctgcaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttggtgagtatggggcctccccaggagtgggacatggatggagggaggcttggaaaggaggtggcaactgctaaagtgctttgactctggggagaagcaagtagagggctagacttgggagaatggggttctagcccgggcttggccagtcacccacagcgtggcctccctccttgggcctttctttccccaagtgttgaacttagtggacctccaaggctcctttctgcttctggaactctgccatctctggctgaagggttacctttctcatggtgtttatatttcacgcccccttctgaatagctgaagaggaattgtagacacccctggagatcttcaggaagtcaaacatta

SEQ ID NO: 418900 - DNA, 2115 bp, Homo sapiens
ggagttgagaattagggaggaggtggtagagtccgggtagtgagcggagggacaggaagggtagggcaagaaagggagaggggacaggagggaagggtgggccaaagcggtgagaaaggagggccagccagttgggtgggggagagggccgaggcccgggggcaggagtgcagggctctgaggcggggagaggagaggagagaagagccgcggggggcccagcccggagccaggatgcccgcgccgcgcgcccgggagcagccccgcgtgcccggggagcgccagccgctgctgcctcgcggtgcgcggggccctcgacggtggcggcgggcggcgggcgcggccgtgctgctggtggagatgctggagcgcgccgccttcttcggcgtcaccgccaacctcgtgctgtacctcaacagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacgatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcacga

SEQ ID NO: 418901 - DNA, 1946 bp, Homo sapiens
ggagttgagaattagggaggaggtggtagagtccgggtagtgagcggagggacaggaagggtagggcaagaaagggagaggggacaggagggaagggtgggccaaagcggtgagaaaggagggccagccagttgggtgggggagagggccgaggcccgggggcaggagtgcagggctctgaggcggggagaggagaggagagaagagccgcggggggcccagcccggagccaggatgcccgcgccgcgcgcccgggagcagccccgcgtgcccggggagcgccagccgctgctgcctcgcggtgcgcggggccctcgacggtggcggcgggcggcgggcgcggccgtgctgctggtggagatgctggagcgcgccgccttcttcggcgtcaccgccaacctcgtgctgtacctcaacagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcacga

SEQ ID NO: 418902 - DNA, 994 bp, Homo sapiens
tgagcctggggggagggctgcaggggactgagaggggagtgtaggcagtgggggtgagggggacagggaggaggtggagaagacggcaaggggcagcagggtgactgggatgcagtccacctatgtcctgcagggtcttcacctccacatcccaaacattttcccagccaacccggccaacatctctgtggccctgagagcccagggcagcagctacacgatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcacga

SEQ ID NO: 418903 - DNA, 2775 bp, Homo sapiens
ggcacgaggctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtatccgggcattgccgacaggatgcagaaggagatcaccgccctggcgcccagcaccatgaagatcaagatcatcgcacccccacatctgctggaaggtggacccttggcgctgttggtggcggcggagacagctgtgaagtgtgaggttctttgtctgctggcagctaggggcgacgaggcgggacgtcatggaagtgaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacaggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccatccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctggccaacatggtgaaacccccatctctactaaagatataaaaaactagccgagcgtggtgttgcatgcctgtgatcccagctactcgggaggctgaggcgggggaatcgcttgaacctctgcctcccagattcaagcgattctggtgccttagcctcctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 418904 - DNA, 2542 bp, Homo sapiens
cgcgaggttccgggtccgccaagctcccggcatgcagcgcggcgatcccggcgagcaccttggcgcgcggagctggcaccttggcgctgttggtggcggcggagacagctgtgaagtgtgaggttctttgtctgctggcagctaggggcgacgaggcgggacgtcatggaagtgaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacaggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccatccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctggccaacatggtgaaacccccatctctactaaagatataaaaaactagccgagcgtggtgttgcatgcctgtgatcccagctactcgggaggctgaggcgggggaatcgcttgaacctctgcctcccagattcaagcgattctggtgccttagcctcctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 418905 - DNA, 2663 bp, Homo sapiens
ggcacgaggctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtatccgggcattgccgacaggatgcagaaggagatcaccgccctggcgcccagcaccatgaagatcaagatcatcgcacccccacatctgctggaaggtggacccttggcgctgttggtggcggcggagacagctgtgaagtgtgaggttctttgtctgctggcagctaggggcgacgaggcgggacgtcatggaagtgaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacaggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccatccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctggccaacatggtgaaacccccatctctactaaagatataaaaaacctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 418906 - DNA, 2065 bp, Homo sapiens
ggcacgaggctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtatccgggcattgccgacaggatgcagaaggagatcaccgccctggcgcccagcaccatgaagatcaagatcatcgcacccccacatctgctggaaggtggacccttggcgctgttggtggcggcggagacagctgtgaagtgtgaggttctttgtctgctggcagctaggggcgacgaggcgggacgtcatggaagtgaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacaggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattccctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 418907 - DNA, 2429 bp, Homo sapiens
ggcacgaggctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtatccgggcattgccgacaggatgcagaaggagatcaccgccctggcgcccagcaccatgaagatcaagatcatcgcacccccacatctgctggaaggtggacccttggcgctgttggtggcggcggagacagctgtgaagtgtgaggttctttgtctgctggcagctaggggcgacgaggcgggacgtcatggaagtgaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacaggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaacccctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 418908 - DNA, 2696 bp, Homo sapiens
ggcctggtggctctcacacctgtaaaggaagaggaagaggaggaggagcaggaggaaacagccaggcgtggtggctcacgcctgtaaaggagaaagaggaggaagaaacagccaggcacagtggctcaagcctgcaaaggaggaggaggaaacagccagttgcagtggctcacgcctgtagaggaggaggaggagacagccaggcacagtggctcatgcctgtaaaggaggaggaggaggagcaggaggaagaagaaacagccaggaagggtggctcatgccggtaaaggaggagaaggaagaggaggaggaggaggaaacagccaggaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacaggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccatccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctggccaacatggtgaaacccccatctctactaaagatataaaaaactagccgagcgtggtgttgcatgcctgtgatcccagctactcgggaggctgaggcgggggaatcgcttgaacctctgcctcccagattcaagcgattctggtgccttagcctcctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 418909 - DNA, 2373 bp, Homo sapiens
cgcgaggttccgggtccgccaagctcccggcatgcagcgcggcgatcccggcgagcaccttggcgcgcggagctggcaccttggcgctgttggtggcggcggagacagctgtgaagtgtgaggttctttgtctgctggcagctaggggcgacgaggcgggacgtcatggaagtgaaggatgccaattctgcgcttctcagtaactacgagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacaggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccatccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctggccaacatggtgaaacccccatctctactaaagatataaaaaactagccgagcgtggtgttgcatgcctgtgatcccagctactcgggaggctgaggcgggggaatcgcttgaacctctgcctcccagattcaagcgattctggtgccttagcctcctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 418910 - DNA, 2527 bp, Homo sapiens
gcattgccgttcactgcagtgatctggtccctaacatttagcctaaacagtgagctggtaaacaaagcccctgccagcagagaaaaggggctctagagctgttgaaggattggccaggccggttcttttcttatctctgttgttctcgaggaaattcctctaaggtgagccaaggtcagtggctcattttaacttagagtaactctctggggactctaaccagacttccaacagtgctctgggccccttagtaagttcccagggaagcagatgaaactaattaggacatggtccaccaaaggcgacacaagcattttccccgctgtgcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacaggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccatccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctggccaacatggtgaaacccccatctctactaaagatataaaaaactagccgagcgtggtgttgcatgcctgtgatcccagctactcgggaggctgaggcgggggaatcgcttgaacctctgcctcccagattcaagcgattctggtgccttagcctcctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 418911 - DNA, 2443 bp, Homo sapiens
cgcgaggttccgggtccgccaagctcccggcatgcagcgcggcgatcccggcgagcaccttggcgcgcggagctggcaccttggcgctgttggtggcggcggagacagctgtgaagtgtgaggttctttgtctgctggcagctaggggcgacgaggcgggacgtcatggaagtgaaggatgccaattctgcgcttctcagtaactacgagacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacaggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccatccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctggccaacatggtgaaacccccatctctactaaagatataaaaaactagccgagcgtggtgttgcatgcctgtgatcccagctactcgggaggctgaggcgggggaatcgcttgaacctctgcctcccagattcaagcgattctggtgccttagcctcctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 418912 - DNA, 1819 bp, Homo sapiens
cgcgaggttccgggtccgccaagctcccggcatgcagcgcggcgatcccggcgagcaccttggcgcgcggagctggcaccttggcgctgttggtggcggcggagacagctgtgaagtgtgaggttctttgtctgctggcagctaggggcgacgaggcgggacgtcatggaagtgaaggatgccaattctgcgcttctcagtaactacgagacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccatccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctctgcctcccagattcaagcgattctggtgccttagcctcctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 418913 - DNA, 1457 bp, Homo sapiens
ggcacgaggctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtatccgggcattgccgacaggatgcagaaggagatcaccgccctggcgcccagcaccatgaagatcaagatcatcgcacccccacatctgctggaaggtggacccttggcgctgttggtggcggcggagacagctgtgaagtgtgaggttctttgtctgctggcagctaggggcgacgaggcgggacgtcatggaagtgtaagtcttctcgggcgcgtcccttttcgcccgaggagcccaacggtttgaccgctgagagctgagagccgagagccgtggggactgggcgaccctcgtacgggagtgagggcagcgggccggccctgtccgggagggccgcggggtggtgacggggacgaacgggactctcgctttgcccttccgaaccttcgcttcccctccacgccgtgtctggtgcggggccgagcacttccgtgtccggctgcctttcaatgtgccccctccttctctcattcgtttaccagcgtttctgggtcacagtgcgggggtggagcccagtctggtatccgaccccggacttagaaggctataaaggcctgagtctgtccgccctgaaagtaggtggaggagagacgaatcagggccgggtagagctctgcttgcagctgtaggcccctggagagccctcggaagagctgccctcggaatttgatgggagcagtaaacactgtgagggaaggggctggttttggggtggagaagggaaggacgtgaaccaggactgggaccagagaaacagcagggggtgtgtgggtgtgtgtgcaaggcgagggtaaaagattttctgacagtttaactccacgtggtcttttccatgcttgctcgttgcgcctggtgcaaatggaagattttgcatctactctgaatgtgggctttatacggttgatattaatttgtaggtattactatcttgtgttctctttgaactgattatttgatacagtttcctttatgttcttttgcctcatgtttaatggttatatgtactatggcatttcacatttttacatttttaattaattgttttttcttaagaaacagggtcttgctctgtcccccaggcggggtgtaatcatggttcactgcagcctcactttctggactcaagcaatccttctcagctacttacgaggctgagatgggaggatcacttgatcccaggaggctgcaatgagctgagatagagccactacactcctgccagagtgacagtgtaaggctctgtctt

SEQ ID NO: 418914 - DNA, 618 bp, Homo sapiens
aggtggaggagagacgaatcagggccgggtagagctctgcttgcagctgtaggcccctggagagccctcggaagagctgccctcggaatttgatgggagcagtaaacactgtgagggaaggggctggttttggggtggagaagggaaggacgtgaaccaggactgggaccagagaaacagcagggggtgtgtgggtgtgtgtgcaaggcgagggtaaaagattttctgacagtttaactccacgtggtcttttccatgcttgctcgttgcgcctggtgcaaatggaagattttgcatctactctgaatgtgggctttatacggttgatattaatttgtaggtattactatcttgtgttctctttgaactgattatttgatacagtttcctttatgttcttttgcctcatgtttaatggttatatgtactatggcatttcacatttttacatttttaattaattgttttttcttaagaaacagggtcttgctctgtcccccaggcggggtgtaatcatggttcactgcagcctcactttctggactcaagcaatcctgcttcagcctcttcagtagctgggactacaggcccacgccatcactcaccgctaatttttta

SEQ ID NO: 418915 - DNA, 2657 bp, Homo sapiens
ggcacgaggctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtatccgggcattgccgacaggatgcagaaggagatcaccgccctggcgcccagcaccatgaagatcaagatcatcgcacccccacatctgctggaaggtggacccttggcgctgttggtggcggcggagacagctgtgaagtgtgaggttctttgtctgctggcagctaggggcgacgaggcgggacgtcatggaagtgaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacaggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccatccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctctgcctcccagattcaagcgattctggtgccttagcctcctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 418916 - DNA, 3048 bp, Homo sapiens
ggcacgaggctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtatccgggcattgccgacaggatgcagaaggagatcaccgccctggcgcccagcaccatgaagatcaagatcatcgcacccccacatctgctggaaggtggacccttggcgctgttggtggcggcggagacagctgtgaagtgtgaggttctttgtctgctggcagctaggggcgacgaggcgggacgtcatggaagtgaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacaggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccatccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctggccaacatggtgaaacccccatctctactaaagatataaaaaactagccgagcgtggtgttgcatgcctgtgatcccagctactcgggaggctgaggcgggggaatcgcttgaaccggggaggcagaggttgcagtgagccagatcgtgcattgcactccagcctggccgacagggtgagactccatctcaaaaaagagaaagtaccagattgtacttttaaatctgtctagcgtattgagaattttagtgggagctgttgatttatttctcagggcatacatgtgccaatctgtctcattgttgtctctctctttttttttttttttttgagacagtctcgctgtgttgcccaggagtgcagtggcacgatctctgctcactgcaacctctgcctcccagattcaagcgattctggtgccttagcctcctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 418917 - DNA, 2637 bp, Homo sapiens
ggcacgaggctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtatccgggcattgccgacaggatgcagaaggagatcaccgccctggcgcccagcaccatgaagatcaagatcatcgcacccccacatctgctggaaggtggacccttggcgctgttggtggcggcggagacagctgtgaagtgtgaggttctttgtctgctggcagctaggggcgacgaggcgggacgtcatggaagtgaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacaggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccatccatccatcccagtccccaggcatcttaacctctgcctcccagattcaagcgattctggtgccttagcctcctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgagaaaaaaaaaaacgaaaaaacggaccaccaaacagactgcgcacactgacacaactacgccaccgacacacagacacagaaaaaactcaaaacactccatgcaaccccaactacataagaacacctgc

SEQ ID NO: 418918 - DNA, 2512 bp, Homo sapiens
ggcacgaggctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtatccgggcattgccgacaggatgcagaaggagatcaccgccctggcgcccagcaccatgaagatcaagatcatcgcacccccacatctgctggaaggtggacccttggcgctgttggtggcggcggagacagctgtgaagtgtgaggttctttgtctgctggcagctaggggcgacgaggcgggacgtcatggaagtgaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacaggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccatccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 418919 - DNA, 2394 bp, Homo sapiens
cctccacctcctgggttcaagagattctcctgcctcagcctcctgagtagctgggactacaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacaggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccatccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctggccaacatggtgaaacccccatctctactaaagatataaaaaactagccgagcgtggtgttgcatgcctgtgatcccagctactcgggaggctgaggcgggggaatcgcttgaacctctgcctcccagattcaagcgattctggtgccttagcctcctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 418920 - DNA, 2147 bp, Homo sapiens
  misc_feature (14)..(14): n is a, c, g, or t
  misc_feature (23)..(23): n is a, c, g, or t
  misc_feature (25)..(26): n is a, c, g, or t
  misc_feature (41)..(41): n is a, c, g, or t
tgcatggaatttgnacgagaccntnntgaaccacctggccntgtgacgtgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacaggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccatccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctggccaacatggtgaaacccccatctctactaaagatataaaaaactagccgagcgtggtgttgcatgcctgtgatcccagctactcgggaggctgaggcgggggaatcgcttgaacctctgcctcccagattcaagcgattctggtgccttagcctcctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 418921 - DNA, 1559 bp, Homo sapiens
ggcacgaggctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtatccgggcattgccgacaggatgcagaaggagatcaccgccctggcgcccagcaccatgaagatcaagatcatcgcacccccacatctgctggaaggtggacccttggcgctgttggtggcggcggagacagctgtgaagtgtgaggttctttgtctgctggcagctaggggcgacgaggcgggacgtcatggaagtgaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattccctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 418922 - DNA, 452 bp, Homo sapiens
accgtgggcctttgactgagctgcagggagggagagagatggacccagtcagccagaagggttgaccatggcacttggtcctgtctgtgaacttgcaggtgtggaaaataaggttcagtgaggcgatggatgcatcgcataacggagtctcactctgttgcccaggctggagttcaatggtgcaatgatctcggctcactgcaacctccgcctcttgggtgcaagtaactctcctgcctcagcctcccgagtagctgggattacagcaatggtgaaaggcagttttcctcgaatgagagcatcagacaggcatgcccgggaccagctgtgggaatcctggagagacagacatgaagcacttcacttggaaatgctttcttagtctttcaatttaacattcaaagggatgagggatttttatcaacagcagccagctgcaatgcaaagtcatg

SEQ ID NO: 418923 - DNA, 324 bp, Homo sapiens
gagaagacgacagaaggggtaggggaactgctgcccacctatacccactacctgccccctggctctcccactccatacaaccctccccttgctggtgcccccatgcccctaacccacctctaaccctcatggacgcagacctcacgggacgggcctcatcctccttttttaatccagcagcatcccctaccccaggctgtcaaccctttctcctgttggactacagttcagaggcagcctgcagtcctcccatgatagccagggagagccgcacaacatacaattatatttttggtagtattaaacagttttgtattattcaac

SEQ ID NO: 418924 - DNA, 1245 bp, Homo sapiens
ggtggggggggcggggggcgtggcaccctgagggtgttgggggctgggacaaacaggacacctgggtttacctacgggctgaggatgttggcgcccttaaggaggtgcagtcttatgggagggacaggggcggagtcagtctttaaaagctgttcccaggtctggcccgcctgccacaaacgctgagcccaggtgggagaggtctggcctatccgcgcctggcagctgtcggaactccggagaccacaaaggggtttatggtttaccccctccacggaaggatcgacgcttcacgttgaggggagggcattcaggacgccctcttaaggcttctcccaacccatggcgctaccaggctcctcacaggaccaggcctggagcctggagcctccggctgccacggctgctgcctcctcatcttcgggaccccaggagcgggagggcgctgggagccccgcggcccccgggacgctgcccctggagaaggtgaagcggccgatgaacgcgttcatggtgtggagctccgctcagcgccgccagatggcgcagcagaaccccaagatgcacaactccgagatctccaagcgcctgggcgcgcagtggaagctgctggacgaggacgagaagcggcccttcgtggaggaggccaagcggctccgcgcccgacacctgcgcgactaccccgactacaagtaccggcctcggcgcaaggccaagagctcgggcgccggaccttcccgctgcggacagggaagaggcaacctggccagcggcggcccgctctgggggccggggtacgcgaccacccaaccgagcagaggctttgggtacagaccccccagctactcgacagcctacctgcctggcagctatggctcttcccactgcaaactggaagccccctcaccgtgctccctccctcagagtgaccctaggctccagggggaactgctgcccacctatacccactacctgccccctggctctcccactccatacaaccctccccttgctggtgcccccatgcccctaacccacctctaaccctcatggacgcagacctcacgggacgggcctcatcctccttttttaatccagcagcatcccctaccccaggctgtcaaccctttctcctgttggactacagttcagaggcagcctgcagtcctcccatgatagccagggagagccgcacaacatacaattatatttttggtagtattaaacagttttgtattattcaac

SEQ ID NO: 418925 - DNA, 1493 bp, Homo sapiens
ggtggggggggcggggggcgtggcaccctgagggtgttgggggctgggacaaacaggacacctgggtttacctacgggctgaggatgttggcgcccttaaggaggtgcagtcttatgggagggacaggggcggagtcagtctttaaaagctgttcccaggtctggcccgcctgccacaaacgctgagcccaggtgggagaggtctggcctatccgcgcctggcagctgtcggaactccggagaccacaaaggggtttatggtttaccccctccacggaaggtcggtctgatcgcagctgcgggtcggggagagggaccgggggtcccccagtcagtaggcctcagaacacctcttcagtgccggggcaccagacagcggattttgcattcgactctccccaaagtgtgccgaacaggttggaagcaaaggctccggtttaagctctgggcttggggataaaatacactttttaaggacccaagttcctcggcaacgactccagactgggaagacctttccattttcaggatcgacgcttcacgttgaggggagggcattcaggacgccctcttaaggcttctcccaacccatggcgctaccaggctcctcacaggaccaggcctggagcctggagcctccggctgccacggctgctgcctcctcatcttcgggaccccaggagcgggagggcgctgggagccccgcggcccccgggacgctgcccctggagaaggtgaagcggccgatgaacgcgttcatggtgtggagctccgctcagcgccgccagatggcgcagcagaaccccaagatgcacaactccgagatctccaagcgcctgggcgcgcagtggaagctgctggacgaggacgagaagcggcccttcgtggaggaggccaagcggctccgcgcccgacacctgcgcgactaccccgactacaagtaccggcctcggcgcaaggccaagagctcgggcgccggaccttcccgctgcggacagggaagaggcaacctggccagcggcggcccgctctgggggccggggtacgcgaccacccaaccgagcagaggctttgggtacagaccccccagctactcgacagcctacctgcctggcagctatggctcttcccactgcaaactggaagccccctcaccgtgctccctccctcagagtgaccctaggctccagggggaactgctgcccacctatacccactacctgccccctggctctcccactccatacaaccctccccttgctggtgcccccatgcccctaacccacctctaaccctcatggacgcagacctcacgggacgggcctcatcctccttttttaatccagcagcatcccctaccccaggctgtcaaccctttctcctgttggactacagttcagaggcagcctgcagtcctcccatgatagccagggagagccgcacaacatacaattatatttttggtagtattaaacagttttgtattattcaac

SEQ ID NO: 418926 - DNA, 389 bp, Homo sapiens
actggggtggcccagagtccagcgacaagggcgaccccttcgctacctgtctgcacgtcccagcacccaagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 418927 - DNA, 487 bp, Homo sapiens
gtctcactccgtcactccatggctggagtgcaggagtgcgatcatagctcactgtcccgtcaaactccgaggctcaggtgatcctcccacctcagcctcccaagtagctaggactacaggcttgcaactgtgggtgacaggatatgcactgctggggtccaggaggggcagtcctccaactcccagggcaggccctggctaaggcagtcacaagggccaagttcctcttgaaacccagaattaagtacagcccctttgttcctcaaccctgcagctcccatcatccctcccccacacagtgctctctggagtacagggtacgagctgcaggtgctagatggggaaaatgaggtggaggctccatggtgggggctagaacctgggactcctgattactagttggggtccctcccctagacaaagcccagattctcattcccaacagatccagggaagaaacaaagcagataataccttcaggctttaa

SEQ ID NO: 418928 - DNA, 556 bp, Homo sapiens
taattagccagatgtggtagctcacacctgaggtcctagctactcggaaggctgaggcaggagaatcgcttgaacccaagaggcagaggttgcagtgagtcgagatcacaccggtgtactccagcctgggcaacagagtgagaccctgtctctaaataaataaaagcacataaagaggggacattttggcttgcaactgtgggtgacaggatatgcactgctggggtccaggaggggcagtcctccaactcccagggcaggccctggctaaggcagtcacaagggccaagttcctcttgaaacccagaattaagtacagcccctttgttcctcaaccctgcagctcccatcatccctcccccacacagtgctctctggagtacagggtacgagctgcaggtgctagatggggaaaatgaggtggaggctccatggtgggggctagaacctgggactcctgattactagttggggtccctcccctagacaaagcccagattctcattcccaacagatccagggaagaaacaaagcagataataccttcaggctttaa

SEQ ID NO: 418929 - DNA, 987 bp, Homo sapiens
ctcctctttgacatttccaccatattccccttaggtatgtacctgtttggactttaatttagagtgtaacttttggtcaagaatcctggagagaaaagacgggtactaaagcctcgctagtgatttacctgggtgccgacccccacaactcatccaccctacatgcatacttcaaactcctccaggcagatactccctgcctgacacacagtgacactttgggaaaaattgcagaacagtaaccaactctgagcagataaatgtgatgtcaaaatgatagtaatgagagatgtcgttcgttgaaagcctgctagctgccatgcactatactatttcttacatctaaatctgattaagttataccccattttataaatagacactttgataagtaaacctatctaagatcaaaatactgagaaatgtcctaattggggatttgaacctggttctaattccaaagtccaagctacatccaccccaacctcctacctcctatctccaagactttgtgagtaaaaaaacaagtgtcacttctctccttctcttttttctgtcctaaaggaagctgggagctaaccacttaggactagtactaatctttcagagaaagggatgaggggagccttgttatttctgtggggttcagctctcagaccagagtaagacaggcaacaaggttgaggagtagccatatgcagaaataacctgtgtatctagccacaggatctccaacactgtgtcactcgggaatcaaaatacagagacagttcctcaatagagtgtggatctagcccagaatgtggacaaggggagtggagaaggggagaggtacacactgagcattgtaacaaggcctgtcctcaagcttgaggaggattaggaagatggcttgagtctgggagtaggaggctgcagtgagctatgattgtaccactgtaccccagcctaggtgacagagtgagaccctgtctcttaaaagaaaaa

SEQ ID NO: 418930 - DNA, 745 bp, Homo sapiens
cgcgacccgccccgtcccgtccagtctggcctgggcgccgcgggaacgctgtcctagctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaactta

SEQ ID NO: 418931 - DNA, 867 bp, Homo sapiens
cgcgacccgccccgtcccgtccagtctggcctgggcgccgcgggaacgctgtcctagctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtggggtggaaaaattcgtgttttgggtgtgaagattcagggggttttgctgaaggagcttcagctggactgaggctgctggcctacctctcctgcctctggctgtgactgacattccttccctcagagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaactta

SEQ ID NO: 418932 - DNA, 171 bp, Homo sapiens
aattcaagcttctaacgatgtacggggacatggtgccagccctcctgggcctcattgggtatcacctatacagaaaggccaatagacccaaagtctccaaaaagaagctcaaggaagagaaacgaaacaagagcaaaaagaaataataaataataaattttaaaaaactta

SEQ ID NO: 418933 - DNA, 2148 bp, Homo sapiens
cgcgacccgccccgtcccgtccagtctggcctgggcgccgcgggaacgctgtcctagctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagggactaaagacaacctgatgaggccacctggcatgacctccagcagccagtaacttgttagggaagagacctgcttgggccacatgggtctgctgcctgtgccaccacctttcccagaacactggacttctttcctgcccttttctacaactctacgctgtgtcagctgtacagccaccccccaccccttcctttcagcctccatcagggaagagacagtaaaaataatcacagtcaagtgattcaaaacaaaacaaaaagcaactgttaaagccaagtctgccccataactttaaaagccatcattggtcactgccgatgtctatttttgaagggttgagatggacagatttcccaagatgcatatcttttgctttcagttctaacaaatgttctattagctaaaatgtgttgtactccacagagtattgggctcgtaattcttttttttttttggagatggagtttcactcttgttgcccaggctggagtgcaatagtgcaatcttcactcaccacaacctccgccacccgggttcaagcaattctcctgtctcagcctcccgagtagctgggattacaggcatgcgccaccacgaccggctaattttatacttttagtagagatggggcttctccatgttggtcaggctggtctcaaactcccaacctcaggtgatccgcctgccttggcttcccaaagtgcggggattacaggcatgagccaccgcgcctggctgggctcgttaattcttatcctagttccagcttagaggaaggcctggaaggagggtagggggaccaaggagaaacttttacccaaagccctattacctccccattcccagtgctgcttatttgtacctcttctgcccactcatttctgttccacctgcccctttacttcttaagcagcatcctcatccttcttcctcttcagctcttatgttgaaactcctgttatctcataatcacgttgaatgtgctcattggttggttgattttttaaagtctagtttaaatccatttaatttcagccctgcaaagactctatccgtgtggttatttggaaatacgataaattagtagttagtatagagggttctcccacttacaaatggagaagagcctgtacatttcatattcacagaaagttttcctgcattcaaagacttgtcactggacccaagccacatgtgtagttggggtcaacatgattatcactggactctgctcgtaaatcctcctctactcttgtctaaaggaattcaagcccacatttaaatcttgtcagcttcatagttgttggctttgctgtggcctacgctccctattttcattcagattctgagccctggataaaatgcagagagtctaaccctctccacccctctgcctctccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaactta

SEQ ID NO: 418934 - DNA, 2518 bp, Homo sapiens
cgcgacccgccccgtcccgtccagtctggcctgggcgccgcgggaacgctgtcctagctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtggggtgagtatctcggcaggggtgggcctgggtaccccctttgcatgggtagaggctttctcggccatcctcactccttaagcaggagaatgtggaataaaggaccctgcttcccactggacaggtccaggtcagtgggacctctgagggcattcaaagcctctgtgcctcttgcgctgttgcttttgtcgggggagttgaggcacatggggagatggacacctttgctggccagcctgtttggtgttcaggtggaaaaattcgtgttttgggtgtgaagattcagggggttttgctgaaggagcttcagctggactgaggctgctggcctacctctcctgcctctggctgtgactgacattccttccctcagagagaagcgaagggcaatcattccttctcacttggcctatggaaaacggggatttccaccatctgtcccagggactaaagacaacctgatgaggccacctggcatgacctccagcagccagtaacttgttagggaagagacctgcttgggccacatgggtctgctgcctgtgccaccacctttcccagaacactggacttctttcctgcccttttctacaactctacgctgtgtcagctgtacagccaccccccaccccttcctttcagcctccatcagggaagagacagtaaaaataatcacagtcaagtgattcaaaacaaaacaaaaagcaactgttaaagccaagtctgccccataactttaaaagccatcattggtcactgccgatgtctatttttgaagggttgagatggacagatttcccaagatgcatatcttttgctttcagttctaacaaatgttctattagctaaaatgtgttgtactccacagagtattgggctcgtaattcttttttttttttggagatggagtttcactcttgttgcccaggctggagtgcaatagtgcaatcttcactcaccacaacctccgccacccgggttcaagcaattctcctgtctcagcctcccgagtagctgggattacaggcatgcgccaccacgaccggctaattttatacttttagtagagatggggcttctccatgttggtcaggctggtctcaaactcccaacctcaggtgatccgcctgccttggcttcccaaagtgcggggattacaggcatgagccaccgcgcctggctgggctcgttaattcttatcctagttccagcttagaggaaggcctggaaggagggtagggggaccaaggagaaacttttacccaaagccctattacctccccattcccagtgctgcttatttgtacctcttctgcccactcatttctgttccacctgcccctttacttcttaagcagcatcctcatccttcttcctcttcagctcttatgttgaaactcctgttatctcataatcacgttgaatgtgctcattggttggttgattttttaaagtctagtttaaatccatttaatttcagccctgcaaagactctatccgtgtggttatttggaaatacgataaattagtagttagtatagagggttctcccacttacaaatggagaagagcctgtacatttcatattcacagaaagttttcctgcattcaaagacttgtcactggacccaagccacatgtgtagttggggtcaacatgattatcactggactctgctcgtaaatcctcctctactcttgtctaaaggaattcaagcccacatttaaatcttgtcagcttcatagttgttggctttgctgtggcctacgctccctattttcattcagattctgagccctggataaaatgcagagagtctaaccctctccacccctctgcctctccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaactta

SEQ ID NO: 418935 - DNA, 2320 bp, Homo sapiens
gggatctttggaagagcatccgtgacccctgtagtccgatcgtaggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtggggtgagtatctcggcaggggtgggcctgggtaccccctttgcatgggtagaggctttctcggccatcctcactccttaagcaggagaatgtggaataaaggaccctgcttcccactggacaggtccaggtcagtgggacctctgagggcattcaaagcctctgtgcctcttgcgctgttgcttttgtcgggggagttgaggcacatggggagatggacacctttgctggccagcctgtttggtgttcaggtggaaaaattcgtgttttgggtgtgaagattcagggggttttgctgaaggagcttcagctggactgaggctgctggcctacctctcctgcctctggctgtgactgacattccttccctcagagagaagcgaagggcaatcattccttctcacttggcctatggaaaacggggatttccaccatctgtcccagggactaaagacaacctgatgaggccacctggcatgacctccagcagccagtaacttgttagggaagagacctgcttgggccacatgggtctgctgcctgtgccaccacctttcccagaacactggacttctttcctgcccttttctacaactctacgctgtgtcagctgtacagccaccccccaccccttcctttcagcctccatcagggaagagacagtaaaaataatcacagtcaagtgattcaaaacaaaacaaaaagcaactgttaaagccaagtctgccccataactttaaaagccatcattggtcactgccgatgtctatttttgaagggttgagatggacagatttcccaagatgcatatcttttgctttcagttctaacaaatgttctattagctaaaatgtgttgtactccacagagtattgggctcgtaattcttttttttttttggagatggagtttcactcttgttgcccaggctggagtgcaatagtgcaatcttcactcaccacaacctccgccacccgggttcaagcaattctcctgtctcagcctcccgagtagctgggattacaggcatgcgccaccacgaccggctaattttatacttttagtagagatggggcttctccatgttggtcaggctggtctcaaactcccaacctcaggtgatccgcctgccttggcttcccaaagtgcggggattacaggcatgagccaccgcgcctggctgggctcgttaattcttatcctagttccagcttagaggaaggcctggaaggagggtagggggaccaaggagaaacttttacccaaagccctattacctccccattcccagtgctgcttatttgtacctcttctgcccactcatttctgttccacctgcccctttacttcttaagcagcatcctcatccttcttcctcttcagctcttatgttgaaactcctgttatctcataatcacgttgaatgtgctcattggttggttgattttttaaagtctagtttaaatccatttaatttcagccctgcaaagactctatccgtgtggttatttggaaatacgataaattagtagttagtatagagggttctcccacttacaaatggagaagagcctgtacatttcatattcacagaaagttttcctgcattcaaagacttgtcactggacccaagccacatgtgtagttggggtcaacatgattatcactggactctgctcgtaaatcctcctctactcttgtctaaaggaattcaagcccacatttaaatcttgtcagcttcatagttgttggctttgctgtggcctacgctccctattttcattcagattctgagccctggataaaatgcagagagtctaaccctctccacccctctgcctctccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaactta

SEQ ID NO: 418936 - DNA, 578 bp, Homo sapiens
  misc_feature (16)..(16): n is a, c, g, or t
  misc_feature (18)..(18): n is a, c, g, or t
  misc_feature (27)..(27): n is a, c, g, or t
  misc_feature (31)..(31): n is a, c, g, or t
  misc_feature (33)..(33): n is a, c, g, or t
  misc_feature (42)..(42): n is a, c, g, or t
  misc_feature (44)..(44): n is a, c, g, or t
aacctgcattaccaangnttaaactcntatntntaaagtttntntgagtaaacttgccagttcctacctggcacggagaagtgcagggtggagagatctccgagaagcgccagccttctggggcttcctgttccttacagcgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaactta

SEQ ID NO: 418937 - DNA, 1689 bp, Homo sapiens
cgcgacccgccccgtcccgtccagtctggcctgggcgccgcgggaacgctgtcctagctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagatggagtttcactcttgttgcccaggctggagtgcaatagtgcaatcttcactcaccacaacctccgccacccgggttcaagcaattctcctgtctcagcctcccgagtagctgggattacaggcatgcgccaccacgaccggctaattttatacttttagtagagatggggcttctccatgttggtcaggctggtctcaaactcccaacctcaggtgatccgcctgccttggcttcccaaagtgcggggattacaggcatgagccaccgcgcctggctgggctcgttaattcttatcctagttccagcttagaggaaggcctggaaggagggtagggggaccaaggagaaacttttacccaaagccctattacctccccattcccagtgctgcttatttgtacctcttctgcccactcatttctgttccacctgcccctttacttcttaagcagcatcctcatccttcttcctcttcagctcttatgttgaaactcctgttatctcataatcacgttgaatgtgctcattggttggttgattttttaaagtctagtttaaatccatttaatttcagccctgcaaagactctatccgtgtggttatttggaaatacgataaattagtagttagtatagagggttctcccacttacaaatggagaagagcctgtacatttcatattcacagaaagttttcctgcattcaaagacttgtcactggacccaagccacatgtgtagttggggtcaacatgattatcactggactctgctcgtaaatcctcctctactcttgtctaaaggaattcaagcccacatttaaatcttgtcagcttcatagttgttggctttgctgtggcctacgctccctattttcattcagattctgagccctggataaaatgcagagagtctaaccctctccacccctctgcctctccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaactta

SEQ ID NO: 418938 - DNA, 517 bp, Homo sapiens
ccagcggtccaggtgtgtgttgcgcgcctgctgggagggagagggtgctagatgtatgctcttgatgctctctccccccagggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaactta

SEQ ID NO: 418939 - DNA, 2270 bp, Homo sapiens
cgcgacccgccccgtcccgtccagtctggcctgggcgccgcgggaacgctgtcctagctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtggggtggaaaaattcgtgttttgggtgtgaagattcagggggttttgctgaaggagcttcagctggactgaggctgctggcctacctctcctgcctctggctgtgactgacattccttccctcagagagaagcgaagggcaatcattccttctcacttggcctatggaaaacggggatttccaccatctgtcccagggactaaagacaacctgatgaggccacctggcatgacctccagcagccagtaacttgttagggaagagacctgcttgggccacatgggtctgctgcctgtgccaccacctttcccagaacactggacttctttcctgcccttttctacaactctacgctgtgtcagctgtacagccaccccccaccccttcctttcagcctccatcagggaagagacagtaaaaataatcacagtcaagtgattcaaaacaaaacaaaaagcaactgttaaagccaagtctgccccataactttaaaagccatcattggtcactgccgatgtctatttttgaagggttgagatggacagatttcccaagatgcatatcttttgctttcagttctaacaaatgttctattagctaaaatgtgttgtactccacagagtattgggctcgtaattcttttttttttttggagatggagtttcactcttgttgcccaggctggagtgcaatagtgcaatcttcactcaccacaacctccgccacccgggttcaagcaattctcctgtctcagcctcccgagtagctgggattacaggcatgcgccaccacgaccggctaattttatacttttagtagagatggggcttctccatgttggtcaggctggtctcaaactcccaacctcaggtgatccgcctgccttggcttcccaaagtgcggggattacaggcatgagccaccgcgcctggctgggctcgttaattcttatcctagttccagcttagaggaaggcctggaaggagggtagggggaccaaggagaaacttttacccaaagccctattacctccccattcccagtgctgcttatttgtacctcttctgcccactcatttctgttccacctgcccctttacttcttaagcagcatcctcatccttcttcctcttcagctcttatgttgaaactcctgttatctcataatcacgttgaatgtgctcattggttggttgattttttaaagtctagtttaaatccatttaatttcagccctgcaaagactctatccgtgtggttatttggaaatacgataaattagtagttagtatagagggttctcccacttacaaatggagaagagcctgtacatttcatattcacagaaagttttcctgcattcaaagacttgtcactggacccaagccacatgtgtagttggggtcaacatgattatcactggactctgctcgtaaatcctcctctactcttgtctaaaggaattcaagcccacatttaaatcttgtcagcttcatagttgttggctttgctgtggcctacgctccctattttcattcagattctgagccctggataaaatgcagagagtctaaccctctccacccctctgcctctccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaactta

SEQ ID NO: 418940 - DNA, 762 bp, Homo sapiens
gaggcggtggtggcgagagtcagtctttcagagcacaggatggaacaagaactccagccactgactgtctcatgtatctgcaagggccgaggaaattaatgacccaaggaggctatgatatggtccaaaaacttttcctggattttttccgtaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagtaagcagaggggagtgctggagagtgggaggcaggaccgtctgctgggtctcgctgggctcaccgctggggagcgtgtagggagacctgcagccaggcctcagccgcagtccccataatggagtgttgagaccccaacacctttccccaggggccacagataatctgcggaaaggctgctgaatcggagaaaacacaaggcacataatactgtgcccattttacaggaggaggagcagcagcctgggaggctgtgcccagagaaagagaatagcactggataggtgtagacaggtgaaggcaagaggctccaggctcatcacagcccttccgtataggggatggtgct

SEQ ID NO: 418941 - DNA, 467 bp, Homo sapiens
gaggcggtggtggcgagagtcagtctttcagagcacaggatggaacaagaactccagccactgactgtctcatgtatctgcaagggccgaggaaattaatgacccaaggaggctatgatatggtccaaaaacttttcctggattttttccgtaggcggctgagccagaggccaactgcagaggaactggaacagaggaacattttgaaacgtaagtgactaagcccatggcaatccctgatgttttgtgcccgttcttccaatcaccaacacgccaccactaaccccctgacattgaccccactccgcataacgttttaacctcttctcctcctccatcccctcgccccctcacatatccaccctccctccacctcataccccactgggcctaactcccccccctcctctaccccacacctcccagctacctaacccacatccctcttcaacatcctcccctccccg

SEQ ID NO: 418942 - DNA, 1275 bp, Homo sapiens
gaggcggtggtggcgagagtcagtctttcagagcacaggatggaacaagaactccagccactgactgtctcatgtatctgcaagggccgaggaaattaatgacccaaggaggctatgatatggtccaaaaacttttcctggattttttccgtaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagctgccatccgaaaggagctcaatgaattcaaaagcactgagatggaagttcatgaattgagtagacacttaacaaggtttcaccgaccttaacagtcgaattcctcttgagtgctatgctgtcttcaaaacataaatttataagaaccataagtgctggtatttattcacttccccattacgatgtaaatcttctgaactgccttttttttaaaaagaagaaaaatcaaggaaacacaatcaggattttatgtgtgaaaacgcaaaagtgatggctcggcggtccgagctgctggtcccacttctgacaccaaaatgcatcccaacccccggcagtgccaagggcaccagcagggccctgactgaagactgtctggcaggtggaacggtccttgtcctctccagccaggcccagcaggcactaccttcatgaagtctccagcaaacctcttcctcacaagtgtctgtcatctgagtccaaagaaagctgaaggggtgggtttgttttgggggtactgtgcaaagctaatgatctggttggacttctacacttggccaaatgtactggctccagacatgacatttggtttgggggccctttgaagttgatgccaagaaggagtgaacacttctcagttgcccctggcttttccctcctttcagccaccacccacacaatgaacaaaagggaagggcccatttctgggggagtctggctgcctcttggctacgaaggctggcactgagcacccatcctgctccctctgcctgagctgagctgcctttcaggaagctctggtttagaaggggaaagatgtcatatgctcagttcaaataatcaacccaactgtgtccagagtgt

SEQ ID NO: 418943 - DNA, 2627 bp, Homo sapiens
  misc_feature (1393)..(1393): n is a, c, g, or t
attttctttctctcccttcacccctttctctcctttgctctctttctttctctctcccttttttttcctttttccctctctttcccactccctccccaccccttcccttcctctcccctcccccttcccctccccctcccccgtgcgcgagcctcttcctctcccctcctcccccttccgcctctctccctctccctccgtctccttctccctctcagctcgccgggcgaccctgctcctgcctcccacattaatggcggcatcctcggaggatgatatagaccggcggcccatccggagagtgcgctccaagagcgacacgccgtacctcgcagaggccaggatctcctttaacctgggggcagctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagatcctggcgcccctgtgaaattgccttgtctgccagtgaaactgtcgcctccgctacctccaaagaaagtcatgatctgtatgcccgtgggggggccagacctctcactggtgtcctacacagcccagaagagtggccagcagggtgtggcccagcaccaccacactgtcctgccctcccagatccagcaccagctgcagtacggcagccacggccagcacctcccctccaccaccggctccctccccatgcacccctcgggctgcagaatgatagacgagctcaacaaaacgctggccatgaccatgcagaggctggaaagctctgagcagcgggtcccctgttccacttcttaccacagctctgggttgcactcgggtgatggggtcaccaaagcaggacctatgggccttccagaaataagacaagtgccaactgttgtgattgaatgtgatgacaataaagaaaatgtgcctcatgagtcagactacgaagactcttcttgcctgtatacaagagaagaggaggaagaggaggaggacgaagacgacgacagctcattatacaccagctccctggccatgaaggtctgcaggaaggactccttagccatnaaactcagcaacaggccctccaagcgagagctggaagaaaagaacatccttcccaggcagacggatgaggagcggctggagctgaggcaacagattggcaccaagctcaccaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagctgccatccgaaaggagctcaatgaattcaaaagcactgagatggaagttcatgaattgagtagacacttaacaaggtttcaccgaccttaacagtcgaattcctcttgagtgctatgctgtcttcaaaacataaatttataagaaccataagtgctggtatttattcacttccccattacgatgtaaatcttctgaactgccttttttttaaaaagaagaaaaatcaaggaaacacaatcaggattttatgtgtgaaaacgcaaaagtgatggctcggcggtccgagctgctggtcccacttctgacaccaaaatgcatcccaacccccggcagtgccaagggcaccagcagggccctgactgaagactgtctggcaggtggaacggtccttgtcctctccagccaggcccagcaggcactaccttcatgaagtctccagcaaacctcttcctcacaagtgtctgtcatctgagtccaaagaaagctgaaggggtgggtttgttttgggggtactgtgcaaagctaatgatctggttggacttctacacttggccaaatgtactggctccagacatgacatttggtttgggggccctttgaagttgatgccaagaaggagtgaacacttctcagttgcccctggcttttccctcctttcagccaccacccacacaatgaacaaaagggaagggcccatttctgggggagtctggctgcctcttggctacgaaggctggcactgagcacccatcctgctccctctgcctgagctgagctgcctttcaggaagctctggtttagaaggggaaagatgtcatatgctcagttcaaataatcaacccaactgtgtccagagtgt

SEQ ID NO: 418944 - DNA, 1144 bp, Homo sapiens
aaggttgcattgctagttagcaacagagccattgatttaattctgactttcttttggggggaacatttagagaaataggatatagcaagtatttagtctagagactcagagacacagattgggttctgcaccttgctgctggatccaggctgatggcaggaggtggaggccaccagggctgccccagatgaaactttcaaagccaggtgtgtgttcagtggtactcctgtggggatgacggtgggaagctcgcacctccctctcacggtcaagaacctccctgaagatgggagattggactgttgaatcctgcacctttggcagccccttggtcttgatgtaattgtttgtttccttaggtttcaccgaccttaacagtcgaattcctcttgagtgctatgctgtcttcaaaacataaatttataagaaccataagtgctggtatttattcacttccccattacgatgtaaatcttctgaactgccttttttttaaaaagaagaaaaatcaaggaaacacaatcaggattttatgtgtgaaaacgcaaaagtgatggctcggcggtccgagctgctggtcccacttctgacaccaaaatgcatcccaacccccggcagtgccaagggcaccagcagggccctgactgaagactgtctggcaggtggaacggtccttgtcctctccagccaggcccagcaggcactaccttcatgaagtctccagcaaacctcttcctcacaagtgtctgtcatctgagtccaaagaaagctgaaggggtgggtttgttttgggggtactgtgcaaagctaatgatctggttggacttctacacttggccaaatgtactggctccagacatgacatttggtttgggggccctttgaagttgatgccaagaaggagtgaacacttctcagttgcccctggcttttccctcctttcagccaccacccacacaatgaacaaaagggaagggcccatttctgggggagtctggctgcctcttggctacgaaggctggcactgagcacccatcctgctccctctgcctgagctgagctgcctttcaggaagctctggtttagaaggggaaagatgtcatatgctcagttcaaataatcaacccaactgtgtccagagtgt

SEQ ID NO: 418945 - DNA, 676 bp, Homo sapiens
  misc_feature (675)..(675): n is a, c, g, or t
gaggcggtggtggcgagagtcagtctttcagagcacaggatggaacaagaactccagccactgactgtctcatgtatctgcaagggccgaggaaattaatgacccaaggaggctatgatatggtccaaaaacttttcctggattttttccgtaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagctgccatccgaaaggagctcaatgaattcaaaagcactgagatggaagttcatgaattgagtagacacttaacaaggtttcaccgaccttaacagtcgaattcctcttgagtgctatgctgtcttcaaaacataaatttataagaaccataagtgctggtatttattcacttccccattacgatgtaaattttgcgtcaaaaaaacttactgttggtagagtgataaaacttatgcggcggcaagattaatccctttagtna

SEQ ID NO: 418946 - DNA, 1250 bp, Homo sapiens
tgagtcagaagactcccagagattggggacggccgaggcaggtcgggggtctggtttggatccccgggttactttctgtttcattttgaaatgttccctgtttctgcaaccggttgcctccaatgtcaagtaaaacgcaggactccttggagacgccagctgggcttctaaggactggggctctgtgaaggtaagaggcagtctgtgccccaccggctggaggctgccactttagagacgtctgagtacccgcaggtcacacccaggaggggttggtgtgcctgccaactgttctgggctctgagtgaggctggagagaccatcgtggaggcggttttaggttagaaaagggataaaatggacccttcatgccagatgggtggccacctagtccacgctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagtgtctgaagagagtccctctgccagtgagtctggagtcctcctgtcccaagatccttcagccaaaccagtcctgctactgccccccaaaaaacctgctgctttccctggagaccatgaagagaccccagtgaagcagctgccccttctcaagcagcccccggccctgcctcccaaacccactaccaggattgccaaccacttaacagattggcaccaagctcaccaggtaggacagcggcaccctctgcctccctggcagtgggcctttagctctccaggttctagcaaaagaattcagtctcggccgggcgcagtagcttatgcctgtaatcccagcactttgggaggccgaggcaggtggatcacatgaggtcaggagttcaagaccagcctggccaacatggtgaaaccccatctctactaaaaatgcaaaaatta

SEQ ID NO: 418947 - DNA, 485 bp, Homo sapiens
ccctgtgaaattgccttgtctgccagtgaaactgtcgcctccgctacctccaaagaaagtcatgatctgtatgcccgtgggggggccagacctctcactggtgtcctacacagcccagaagagtggccagcagggtgtggcccagcaccaccacactgtcctgccctcccagatccagcaccagctgcagtacggcagccacggccagcacctcccctccaccaccggctccctccccatgcacccctcgggctgcagaatgatagacgagctcaacaaaacgctggccatgaccatgcagaggctggaaaggtaaaggtgggcaccaggagggaggacgggaggagaggggttggctggggaggggggcctagggatttggaccatgacttaggaatgtgaacaaggggtcatccccactgggggaaaatgtttgaaagtaaaatgagacaaaaaactgaaggtcaaagcatggaaaaaaaaaa

SEQ ID NO: 418948 - DNA, 4784 bp, Homo sapiens
  misc_feature (1407)..(1407): n is a, c, g, or t
  misc_feature (1747)..(1747): n is a, c, g, or t
  misc_feature (2566)..(2566): n is a, c, g, or t
  misc_feature (4343)..(4343): n is a, c, g, or t
tatttagcaagatcaaagacactctggctggaacggctcttgttttaccgctgacagatagcctttgatttttattttttgcagtgttccagtgttttctctcaaaactctgtgtttggaacatcaaggatggattatcccaaaatggattattttctggatgtagagtctgctcacagactcttggatgttgagtcagctcaaagattcttctacagtcaaggagctcaagctcgccgggcgaccctgctcctgcctcccacattaatggcggcatcctcggaggatgatatagaccggcggcccatccggagagtgcgctccaagagcgacacgccgtacctcgcagaggccaggatctcctttaacctgggggcagctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagatcctggcgcccctgtgaaattgccttgtctgccagtgaaactgtcgcctccgctacctccaaagaaagtcatgatctgtatgcccgtgggggggccagacctctcactggtgtcctacacagcccagaagagtggccagcagggtgtggcccagcaccaccacactgtcctgccctcccagatccagcaccagctgcagtacggcagccacggccagcacctcccctccaccaccggctccctccccatgcacccctcgggctgcagaatgatagacgagctcaacaaaacgctggccatgaccatgcagaggctggaaagctctgagcagcgggtcccctgttccacttcttaccacagctctgggttgcactcgggtgatggggtcaccaaagcaggacctatgggccttccagaaataagacaagtgccaactgttgtgattgaatgtgatgacaataaagaaaatgtgcctcatgagtcagactacgaagactcttcttgcctgtatacaagagaagaggaggaagaggaggaggacgaagacgacgacagctcattatacaccagctccctggccatgaaggtctgcaggaaggactccttagccatnaaactcagcaacaggccctccaagcgagagctggaagaaaagaacatccttcccaggcagacggatgaggagcggctggagctgaggcaacagattggcaccaagctcaccaggcggctgagccagaggccaactgcagaggaactggaacagaggaacattttgaaacgtaagtgactaagcccatggcaatccctgatgttttgtggcggcttttgttattatttaatggtaggccacaaggtttctaccttgcgcctctgcggaaagcattgaaaacctttctaacggttgaagcttcatgtgtgcatgttagaacaccaaagacgacctccccaangagaaggcaaattttattccactttattctttagaagctcacgggcggcaggcagaaccttccttttagtgagttgtaaagtcagagagaagctgaaaaattagagtgagaccacttattatttaatgatttttaagagcagggtcacctttaaaccagaattggcttgaaaatggagactgtgatatgcacggctaaaataagggaaatgtccatttgaactgagactagaaagcatgactttgcattgcagctggctgctgttgataaaaatccctcatccctttgaatgttaaattgaaagactaagaaagcatttccaagcgaagtgcttcatgtctgtctctcaggattcccacagctggtcccgggcatgcctgtctgatgctctcattcgaggaaaactgcctttcaccattgctgcagacagaaaaaaataaatgagccccttgtttggtttaggacacagagacatttgaatatgtacagaggatccacttggtgctttaaaaaaaaaaagagaaaacaggatacaaaatactaaaagagatcaagcatttgatggacagcagtatgcgtcagtttagtggtagatattaaataacttaaatatcaaaccattctattcattcattgctaccattctcgccaacactggcctcaagatagtgaacaaatatttctggcttaattcatgaccctgttccccctaccccacaacacacttctaatttctctccagaagagaaagatatatactatgcagagttttctagaaatgctatgttgtacagactgactcctcgcctcccccggccnccccgccccgccccgccccgtgcccagtaaatcacatgcaaccgcagtgtgagtttgccgggaatttccactgaaaccacactaagatattcttgactttacctttctaccgtgctcactgtggccttgtgacttggtcggcatttcgtagtctgctgaaggtgggtgctgggttccgctttggtggggagacctgttgcctacagcacccacccccgcccgacgcccccgcatgtccgtttatgtcaactctgcctttatcaatgtcttgcctcccgtccccacgccagccgccacttcctcaactctcagtagaagttattttcaggattagccttcctcagtcgtgggggaaccctacgctttgcctaggtctctaggaatgtgtgtttacttttttctgcccaaggggtaccctttaaagtttccaagcttaatattctatataatgaattcagagctttttcaaagcatttccaaggtcagggaagcatttggcttgtaggatgtcttcctttcggccccaatctggtacctgagccattataaacttcccattgttggagagaaagataaacagccaggtgaacctgtacaacttactcacagcccgctgctgtacttgtggcctctgacctgagacctaaactcaaagaagctaaaagcctccgggggattatttaggtttcagaaaatagtgcttatcacaccaggagtacggtttctggagagatctaaaatcccctagctcagctctgggctctctcaaagatatcagatccccgctgtggcttgtccagatccctgggagactacaggtcctttgagcttgggtttttaccgccatcaaccagggaacttagattcaggggaccaaaaaggagttgtgaaagattgttcccatggttctcttttattctcttccctaatccctcttgtcctggccacatagttgcaaattaaagaactacttgaccaattctaacaggttggtcatttcatagttttgaaacttttcagaaatcaacttgttttcccataggttcttatttttccctgtattctggaactatgttctcctaaatatttttttaaatttaatctattgcgattgttaaacaaaaaaaatgtctagtggtataagaaaacatcctccaatagtttgttttaaaactgattttctgagctttcagccatttgaggaactgctcggtgttgggtggtggggaacagggcacagagatgccatggctcagccctggagctttgagagccttgggttggtttccagccccaccctgcctggtcctgggagcagcccctgttctgtccagcagccagtgaggccctgtgcacctctgagcacataatgaaccctctgatggtggcagctgtaatgacgacatcgtaggcctttcctggcctgtcttcccagttgcctaatggggttgtcttggtaccttctgcctgaaaattcatgaacctgggttggtcaatggctttgaactaaaggtatcaattctgtaggtggtagcttgtggccccacccctcagagtgacctaagaaacgcacataggagatgaaggctccatgctgtgtcagctgtgtcacaggatgcccgccttcacggctctgaagggacctgtaggatcagaagtctgaggctagtaatgaggaggagagccggccccacacaaaacatgaccacaggaaaaaacctatctgtgtaaccactgagccaggtagggtgtgactggccacttaacacccctgagncttcagatcctcagttataaaccaggagtggtagatgaggtggtcactaggtcccctcatggccctagtattctgtgcttctgtaaattttcaccgtgtgccctctagctgtccctggtgacccaacatccagaccaccttttcttccatccgttttcccacctgagacatcgcaaaatgggagttccctccttctggttcttgctgtctgcctccccatttaactctgctagattaattcatactaagatattaatggctgactagtttaataggttttatcccactgaaatttgcatttgtacaaatgtcactgtctgggggctccctacttccgggtgttgctgtctgccccccagtttatctctactagattaattcatactgagctattaatggctgactagtttaatgggcttttattcaagagaaatttgcatt

SEQ ID NO: 418949 - DNA, 779 bp, Homo sapiens
gatgagctgaggatcaacactcacaacggctgacacttaatgacgctatttatcaaatagaccttttgaaaactgatagcatgtgaatttaacagtatatgttccagagaatataaagcaaggaaaggctggtgttccagtgttttctctcaaaactctgtgtttggaacatcaaggatggattatcccaaaatggattattttctggatgtagagtctgctcacagactcttggatgttgagtcagctcaaagattcttctacagtcaaggagctcaagctcgccgggcgaccctgctcctgcctcccacattaatggcggcatcctcggaggatgatatagaccggcggcccatccggagagtgcgctccaagagcgacacgccgtacctcgcagaggccaggatctcctttaacctgggggcaggcgtttccctttttggggatatggatgaagcaagaatgggaccagcagtgccaactcttgggcgtcctcttgggctcgaactgtgttccctggaaaaccacggcctcctgaagacagcccctacatacactacatcagcccacatctgctcaggccccagtacaggtggacaattctctactcagggtatgagccctgttcaaggagctaagagaaggagggtggtttggctgcctttagagggggaagagtttggctgagaggacatttactctttggtccatatgggaagggaaaatgcgggttggcgtgtgtattcatttcctagagttgctgtaacaaagtaccacaa

SEQ ID NO: 418950 - DNA, 2659 bp, Homo sapiens
  misc_feature (1425)..(1425): n is a, c, g, or t
tgagtcagaagactcccagagattggggacggccgaggcaggtcgggggtctggtttggatccccgggttactttctgtttcattttgaaatgttccctgtttctgcaaccggttgcctccaatgtcaagtaaaacgcaggactccttggagacgccagctgggcttctaaggactggggctctgtgaaggtaagaggcagtctgtgccccaccggctggaggctgccactttagagacgtctgagtacccgcaggtcacacccaggaggggttggtgtgcctgccaactgttctgggctctgagtgaggctggagagaccatcgtggaggcggttttaggttagaaaagggataaaatggacccttcatgccagatgggtggccacctagtccacgctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagatcctggcgcccctgtgaaattgccttgtctgccagtgaaactgtcgcctccgctacctccaaagaaagtcatgatctgtatgcccgtgggggggccagacctctcactggtgtcctacacagcccagaagagtggccagcagggtgtggcccagcaccaccacactgtcctgccctcccagatccagcaccagctgcagtacggcagccacggccagcacctcccctccaccaccggctccctccccatgcacccctcgggctgcagaatgatagacgagctcaacaaaacgctggccatgaccatgcagaggctggaaagctctgagcagcgggtcccctgttccacttcttaccacagctctgggttgcactcgggtgatggggtcaccaaagcaggacctatgggccttccagaaataagacaagtgccaactgttgtgattgaatgtgatgacaataaagaaaatgtgcctcatgagtcagactacgaagactcttcttgcctgtatacaagagaagaggaggaagaggaggaggacgaagacgacgacagctcattatacaccagctccctggccatgaaggtctgcaggaaggactccttagccatnaaactcagcaacaggccctccaagcgagagctggaagaaaagaacatccttcccaggcagacggatgaggagcggctggagctgaggcaacagattggcaccaagctcaccaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagctgccatccgaaaggagctcaatgaattcaaaagcactgagatggaagttcatgaattgagtagacacttaacaaggtttcaccgaccttaacagtcgaattcctcttgagtgctatgctgtcttcaaaacataaatttataagaaccataagtgctggtatttattcacttccccattacgatgtaaatcttctgaactgccttttttttaaaaagaagaaaaatcaaggaaacacaatcaggattttatgtgtgaaaacgcaaaagtgatggctcggcggtccgagctgctggtcccacttctgacaccaaaatgcatcccaacccccggcagtgccaagggcaccagcagggccctgactgaagactgtctggcaggtggaacggtccttgtcctctccagccaggcccagcaggcactaccttcatgaagtctccagcaaacctcttcctcacaagtgtctgtcatctgagtccaaagaaagctgaaggggtgggtttgttttgggggtactgtgcaaagctaatgatctggttggacttctacacttggccaaatgtactggctccagacatgacatttggtttgggggccctttgaagttgatgccaagaaggagtgaacacttctcagttgcccctggcttttccctcctttcagccaccacccacacaatgaacaaaagggaagggcccatttctgggggagtctggctgcctcttggctacgaaggctggcactgagcacccatcctgctccctctgcctgagctgagctgcctttcaggaagctctggtttagaaggggaaagatgtcatatgctcagttcaaataatcaacccaactgtgtccagagtgt

SEQ ID NO: 418951 - DNA, 2354 bp, Homo sapiens
  misc_feature (1425)..(1425): n is a, c, g, or t
tgagtcagaagactcccagagattggggacggccgaggcaggtcgggggtctggtttggatccccgggttactttctgtttcattttgaaatgttccctgtttctgcaaccggttgcctccaatgtcaagtaaaacgcaggactccttggagacgccagctgggcttctaaggactggggctctgtgaaggtaagaggcagtctgtgccccaccggctggaggctgccactttagagacgtctgagtacccgcaggtcacacccaggaggggttggtgtgcctgccaactgttctgggctctgagtgaggctggagagaccatcgtggaggcggttttaggttagaaaagggataaaatggacccttcatgccagatgggtggccacctagtccacgctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagatcctggcgcccctgtgaaattgccttgtctgccagtgaaactgtcgcctccgctacctccaaagaaagtcatgatctgtatgcccgtgggggggccagacctctcactggtgtcctacacagcccagaagagtggccagcagggtgtggcccagcaccaccacactgtcctgccctcccagatccagcaccagctgcagtacggcagccacggccagcacctcccctccaccaccggctccctccccatgcacccctcgggctgcagaatgatagacgagctcaacaaaacgctggccatgaccatgcagaggctggaaagctctgagcagcgggtcccctgttccacttcttaccacagctctgggttgcactcgggtgatggggtcaccaaagcaggacctatgggccttccagaaataagacaagtgccaactgttgtgattgaatgtgatgacaataaagaaaatgtgcctcatgagtcagactacgaagactcttcttgcctgtatacaagagaagaggaggaagaggaggaggacgaagacgacgacagctcattatacaccagctccctggccatgaaggtctgcaggaaggactccttagccatnaaactcagcaacaggccctccaagcgagagctggaagaaaagaacatccttcccaggcagacggatgaggagcggctggagctgaggcaacagattggcaccaagctcaccaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagctgccatccgaaaggagctcaatgaattcaaaagcactgagatggaagttcatgaattgagtagacacttaacaaggttagtattaagggttttttttttcctttttttccctcaagttgcaatatttatctccaaataaagctctcccacttgtgggacatgagtgggttggagggtgccatgagagggaagatagtaggaaggcaggcatgcggttccactttaggttactgaaacgaggaagtggaacacagatggcccgggctaaaaccaactttctgcaaagtctgagtttcactcatttaaactaaaggtctgataagcaccagactaccaacgaccccaaggtgggtttttgtgaaaacttaggtcaaggagaaaagattgttgccaatttgcaaccagtcagcagaggccaaacctgaacaaaataccacatccacacgggacttccaaagtggaccacttctgttattccctgacattctccctgacagtccagcatcatgatgatatttgggaaaaccgaggcatggagtgattaagaggattata

SEQ ID NO: 418952 - DNA, 871 bp, Homo sapiens
agatggagtcttacactgtcacccgggctggagtgcaatggcgcaatctcagctcactacaacctctgcctcccgggttcaagcaattctcctgcctcagcctcccaagtagttgagattacagacgtgatgggacctgccttctccactagtagctgggcagctcacaattcacacctgtgtacctgccacatccctcacttggtggaaaacacccagaaggtcttgagtcccccacccctgggtgtcagtccaaatgactgtataggaggcccttatttttgtcacagagcaagctggccatgaacgaaggagagaagacgccacagatttccttccctctcctccaggagaccataagatagatcccccatcctctcagccctattcccatgcctccctctcattggaggagctgaccaaagcagccctaacgggccataacacttgaccaattcagctgctggcagagggaggaaacaagtgttttcccaagtggcattttcatctcgctttcaccctgactaaagattgtcttaagtagcagcccagcccgcccagccccaggtgggtagtggggaggagagctggcattcctccaggtggcaaatggcgactctatactctccgcccgccccagggctggatggattagaaaaatgcctatttttcttgtatcgatgtagagactctattttctcccaaagacactatttttgcagctgtttgaagtttgtatattttccgtactgcagagcttacacaaaattgaagaatgttaatgttcgagttttcttatcttgtgtttagaggttgttttttgcagatcttggtgttaatagaccaaataaataaataaatattcccagca

SEQ ID NO: 418953 - DNA, 2350 bp, Homo sapiens
ggcttggtacggtgccgaaggtcgttttctcgcagtggggctgagtgcaggcagccgggagagccatggcgggggccgcagcgggcggcagaggcggaggtgcctgggggccggggcgcggaggggccggggggctccggcggggctgctctcccccagcccccgccggctccccccgggctgggctgcagccgctcagggccacgatccccttccagctgcagcagccgcaccagcgccgggacgggggtggccgtgcagccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccccagaaggctgtgagaaagtgcgtgtgtttgaagaagccacgtctccaggtcctgacctggccttcctgacttcctgtcctgacaagaacaaagtccatttcaacccgactggctcagccttctgccccgtcaacctgatgaagcccctcttccccggcatgggcttcatcttccgtaactgcccctcaaacccgggatctccccttcccccggccagccccaggccaccacctcggaaggatccggaagcctccaaggcctccccactgccattcgagccatggcagcgcaccccaccatcagaagagcctgtgcttttccagagctccctgatggtctgagggtcccacccctgccccactttaccatagagaccagtgccttggtggcaggtccctccccaggtcccctgagatggggtatggaggggcccttccctctcggccttcgagcactttctttcacttactgtgtcaaagccctgggtcctctttttgatgggcaccggcccctctgaacgtgatgggacctgccttctccactagtagctgggcagctcacaattcacacctgtgtacctgccacatccctcacttggtggaaaacacccagaaggtcttgagtcccccacccctgggtgtcagtccaaatgactgtataggaggcccttatttttgtcacagagcaagctggccatgaacgaaggagagaagacgccacagatttccttccctctcctccaggagaccataagatagatcccccatcctctcagccctattcccatgcctccctctcattggaggagctgaccaaagcagccctaacgggccataacacttgaccaattcagctgctggcagagggaggaaacaagtgttttcccaagtggcattttcatctcgctttcaccctgactaaagattgtcttaagtagcagcccagcccgcccagccccaggtgggtagtggggaggagagctggcattcctccaggtggcaaatggcgactctatactctccgcccgccccagggctggatggattagaaaaatgcctatttttcttgtatcgatgtagagactctattttctcccaaagacactatttttgcagctgtttgaagtttgtatattttccgtactgcagagcttacacaaaattgaagaatgttaatgttcgagttttcttatcttgtgtttagaggttgttttttgcagatcttggtgttaatagaccaaataaataaataaatattcccagca

SEQ ID NO: 418954 - DNA, 2190 bp, Homo sapiens
tgggaagttcgatccttttggtgaagctagtgggcgccattttgaagttgggcagaaagtgactccagtggtggaacccggagccaaccatttttagttacccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccccagaaggctgtgagaaagtgcgtgtgtttgaagaagccacgtctccaggtcctgacctggccttcctgacttcctgtcctgacaagaacaaagtccatttcaacccgactggctcagccttctgccccgtcaacctgatgaagcccctcttccccggcatgggcttcatcttccgtaactgcccctcaaacccgggatctccccttcccccggccagccccaggccaccacctcggaaggatccggaagcctccaaggcctccccactgccattcgagccatggcagcgcaccccaccatcagaagagcctgtgcttttccagagctccctgatggtctgagggtcccacccctgccccactttaccatagagaccagtgccttggtggcaggtccctccccaggtcccctgagatggggtatggaggggcccttccctctcggccttcgagcactttctttcacttactgtgtcaaagccctgggtcctctttttgatgggcaccggcccctctgaacgtgatgggacctgccttctccactagtagctgggcagctcacaattcacacctgtgtacctgccacatccctcacttggtggaaaacacccagaaggtcttgagtcccccacccctgggtgtcagtccaaatgactgtataggaggcccttatttttgtcacagagcaagctggccatgaacgaaggagagaagacgccacagatttccttccctctcctccaggagaccataagatagatcccccatcctctcagccctattcccatgcctccctctcattggaggagctgaccaaagcagccctaacgggccataacacttgaccaattcagctgctggcagagggaggaaacaagtgttttcccaagtggcattttcatctcgctttcaccctgactaaagattgtcttaagtagcagcccagcccgcccagccccaggtgggtagtggggaggagagctggcattcctccaggtggcaaatggcgactctatactctccgcccgccccagggctggatggattagaaaaatgcctatttttcttgtatcgatgtagagactctattttctcccaaagacactatttttgcagctgtttgaagtttgtatattttccgtactgcagagcttacacaaaattgaagaatgttaatgttcgagttttcttatcttgtgtttagaggttgttttttgcagatcttggtgttaatagaccaaataaataaataaatattcccagca

SEQ ID NO: 418955 - DNA, 2184 bp, Homo sapiens
aggtgaccgttgagcccaaacaggcggcgtcaccagccaatcaatatgcttccagacgtttcagcgaccaattaataagaacgcctccgatccagccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccccagaaggctgtgagaaagtgcgtgtgtttgaagaagccacgtctccaggtcctgacctggccttcctgacttcctgtcctgacaagaacaaagtccatttcaacccgactggctcagccttctgccccgtcaacctgatgaagcccctcttccccggcatgggcttcatcttccgtaactgcccctcaaacccgggatctccccttcccccggccagccccaggccaccacctcggaaggatccggaagcctccaaggcctccccactgccattcgagccatggcagcgcaccccaccatcagaagagcctgtgcttttccagagctccctgatggtctgagggtcccacccctgccccactttaccatagagaccagtgccttggtggcaggtccctccccaggtcccctgagatggggtatggaggggcccttccctctcggccttcgagcactttctttcacttactgtgtcaaagccctgggtcctctttttgatgggcaccggcccctctgaacgtgatgggacctgccttctccactagtagctgggcagctcacaattcacacctgtgtacctgccacatccctcacttggtggaaaacacccagaaggtcttgagtcccccacccctgggtgtcagtccaaatgactgtataggaggcccttatttttgtcacagagcaagctggccatgaacgaaggagagaagacgccacagatttccttccctctcctccaggagaccataagatagatcccccatcctctcagccctattcccatgcctccctctcattggaggagctgaccaaagcagccctaacgggccataacacttgaccaattcagctgctggcagagggaggaaacaagtgttttcccaagtggcattttcatctcgctttcaccctgactaaagattgtcttaagtagcagcccagcccgcccagccccaggtgggtagtggggaggagagctggcattcctccaggtggcaaatggcgactctatactctccgcccgccccagggctggatggattagaaaaatgcctatttttcttgtatcgatgtagagactctattttctcccaaagacactatttttgcagctgtttgaagtttgtatattttccgtactgcagagcttacacaaaattgaagaatgttaatgttcgagttttcttatcttgtgtttagaggttgttttttgcagatcttggtgttaatagaccaaataaataaataaatattcccagca

SEQ ID NO: 418956 - DNA, 2118 bp, Homo sapiens
cacaacgacagctgtttgatcagcctagaccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccccagaaggctgtgagaaagtgcgtgtgtttgaagaagccacgtctccaggtcctgacctggccttcctgacttcctgtcctgacaagaacaaagtccatttcaacccgactggctcagccttctgccccgtcaacctgatgaagcccctcttccccggcatgggcttcatcttccgtaactgcccctcaaacccgggatctccccttcccccggccagccccaggccaccacctcggaaggatccggaagcctccaaggcctccccactgccattcgagccatggcagcgcaccccaccatcagaagagcctgtgcttttccagagctccctgatggtctgagggtcccacccctgccccactttaccatagagaccagtgccttggtggcaggtccctccccaggtcccctgagatggggtatggaggggcccttccctctcggccttcgagcactttctttcacttactgtgtcaaagccctgggtcctctttttgatgggcaccggcccctctgaacgtgatgggacctgccttctccactagtagctgggcagctcacaattcacacctgtgtacctgccacatccctcacttggtggaaaacacccagaaggtcttgagtcccccacccctgggtgtcagtccaaatgactgtataggaggcccttatttttgtcacagagcaagctggccatgaacgaaggagagaagacgccacagatttccttccctctcctccaggagaccataagatagatcccccatcctctcagccctattcccatgcctccctctcattggaggagctgaccaaagcagccctaacgggccataacacttgaccaattcagctgctggcagagggaggaaacaagtgttttcccaagtggcattttcatctcgctttcaccctgactaaagattgtcttaagtagcagcccagcccgcccagccccaggtgggtagtggggaggagagctggcattcctccaggtggcaaatggcgactctatactctccgcccgccccagggctggatggattagaaaaatgcctatttttcttgtatcgatgtagagactctattttctcccaaagacactatttttgcagctgtttgaagtttgtatattttccgtactgcagagcttacacaaaattgaagaatgttaatgttcgagttttcttatcttgtgtttagaggttgttttttgcagatcttggtgttaatagaccaaataaataaataaatattcccagca

SEQ ID NO: 418957 - DNA, 2053 bp, Homo sapiens
ctagcctgcatttctctttccatcctctcgcatatcccagaagaaagaggtacttgaagagtttgcaagagatattagtagtacccgtggcggcctgaatgtggctgttttttcctctctgttaccacccacctacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccccagaaggctgtgagaaagtgcgtgtgtttgaagaagccacgtctccaggtcctgacctggccttcctgacttcctgtcctgacaagaacaaagtccatttcaacccgactggctcagccttctgccccgtcaacctgatgaagcccctcttccccggcatgggcttcatcttccgtaactgcccctcaaacccgggatctccccttcccccggccagccccaggccaccacctcggaaggatccggaagcctccaaggcctccccactgccattcgagccatggcagcgcaccccaccatcagaagagcctgtgcttttccagagctccctgatggtctgagggtcccacccctgccccactttaccatagagaccagtgccttggtggcaggtccctccccaggtcccctgagatggggtatggaggggcccttccctctcggccttcgagcactttctttcacttactgtgtcaaagccctgggtcctctttttgatgggcaccggcccctctgaacgtgatgggacctgccttctccactagtagctgggcagctcacaattcacacctgtgtacctgccacatccctcacttggtggaaaacacccagaaggtcttgagtcccccacccctgggtgtcagtccaaatgactgtataggaggcccttatttttgtcacagagcaagctggccatgaacgaaggagagaagacgccacagatttccttccctctcctccaggagaccataagatagatcccccatcctctcagccctattcccatgcctccctctcattggaggagctgaccaaagcagccctaacgggccataacacttgaccaattcagctgctggcagagggaggaaacaagtgttttcccaagtggcattttcatctcgctttcaccctgactaaagattgtcttaagtagcagcccagcccgcccagccccaggtgggtagtggggaggagagctggcattcctccaggtggcaaatggcgactctatactctccgcccgccccagggctggatggattagaaaaatgcctatttttcttgtatcgatgtagagactctattttctcccaaagacactatttttgcagctgtttgaagtttgtatattttccgtactgcagagcttacacaaaattgaagaatgttaatgttcgagttttcttatcttgtgtttagaggttgttttttgcagatcttggtgttaatagaccaaataaataaataaatattcccagca

SEQ ID NO: 418958 - DNA, 2254 bp, Homo sapiens
ggcttggtacggtgccgaaggtcgttttctcgcagtggggctgagtgcaggcagccgggagagccatggcgggggccgcagcgggcggcagaggcggaggtgcctgggggccggggcgcggaggggccggggggctccggcggggctgctctcccccagcccccgccggctccccccgggctgggctgcagccgctcagggccacgatccccttccagctgcagcagccgcaccagcgccgggacgggggtggccgtgcagccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccccagaaggctgtgagaaagtgcgtgtgtttgaagaagccacgtctccaggtcctgacctggccttcctgacttcctgtcctgacaagaacaaagtccatttcaacccgactggctcagccttctgccccgtcaacctgatgaagcccctcttccccggcatgggcttcatcttccgtaactgcccctcaaacccgggatctccccttcccccggccagccccaggccaccacctcggaaggatccggaagcctccaaggcctccccactgccattcgagccatggcagcgcaccccaccatcagaagagcctgtgcttttccagagctccctgatggtctgagggtcccacccctgccccactttaccatagagaccagtgccttggtggcaggtccctccccaggtcccctgagatggggtatggaggggcccttccctctcggccttcgagcactttctttcacttactgtgtcaaagccctgggtcctctttttgatgggcaccggcccctctgaacgtgatgggacctgccttctccactagtagctgggcagctcacaattcacacctgtgtacctgccacatccctcacttggtggaaaacacccagaaggtcttgagtcccccacccctgggtgtcagtccaaatgactgtataggaggcccttatttttgtcacagagcaagctggccatgaacgaaggagagaagacgccacagatttccttccctctcctccaggagaccataagatagatcccccatcctctcagccctattcccatgcctccctctcattggaggagctgaccaaagcagccctaacgggccataacacttgaccaattcagctgctggcagagggaggaaacaagtgttttcccaagtggcattttcatctcgctttcaccctgactaaagattgtcttaagtagcagcccagcccgcccagccccaggtgggtagtggggaggagagctggcattcctccaggtggcaaatggcgactctatactctccgcccgccccagggctggatggattagaaaaatgcctatttttcttgtatcgatgtagagactctattttctcccaaagacactatttttgcagctgtttgaagtttgtatattttccgtactgcagagcttacacaaaattgaagaatgttaatgttcgagttttcttatcttgtgtttagaggttgttttttgcagatcttggtgttaatagaccaaataaataaataaatattcccagca

SEQ ID NO: 418959 - DNA, 2101 bp, Homo sapiens
ggcttggtacggtgccgaaggtcgttttctcgcagtggggctgagtgcaggcagccgggagagccatggcgggggccgcagcgggcggcagaggcggaggtgcctgggggccggggcgcggaggggccggggggctccggcggggctgctctcccccagcccccgccggctccccccgggctgggctgcagccgctcagggccacgatccccttccagctgcagcagccgcaccagcgccgggacgggggtggccgtgcagccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccccagaaggctgtgagaaagtgcgtgtgtttgaagaagccacgtctccaggtcctgacctggccttcctgacttcctgtcctgacaagaacaaagtccatttcaacccgactggctcagccttctgccccgtcaacctgatgaagcccctcttccccggcatgggcttcatcttccgtaactgcccttccctctcggccttcgagcactttctttcacttactgtgtcaaagccctgggtcctctttttgatgggcaccggcccctctgaacgtgatgggacctgccttctccactagtagctgggcagctcacaattcacacctgtgtacctgccacatccctcacttggtggaaaacacccagaaggtcttgagtcccccacccctgggtgtcagtccaaatgactgtataggaggcccttatttttgtcacagagcaagctggccatgaacgaaggagagaagacgccacagatttccttccctctcctccaggagaccataagatagatcccccatcctctcagccctattcccatgcctccctctcattggaggagctgaccaaagcagccctaacgggccataacacttgaccaattcagctgctggcagagggaggaaacaagtgttttcccaagtggcattttcatctcgctttcaccctgactaaagattgtcttaagtagcagcccagcccgcccagccccaggtgggtagtggggaggagagctggcattcctccaggtggcaaatggcgactctatactctccgcccgccccagggctggatggattagaaaaatgcctatttttcttgtatcgatgtagagactctattttctcccaaagacactatttttgcagctgtttgaagtttgtatattttccgtactgcagagcttacacaaaattgaagaatgttaatgttcgagttttcttatcttgtgtttagaggttgttttttgcagatcttggtgttaatagaccaaataaataaataaatattcccagca

SEQ ID NO: 418960 - DNA, 2353 bp, Homo sapiens
  misc_feature (2329)..(2329): n is a, c, g, or t
ggcttggtacggtgccgaaggtcgttttctcgcagtggggctgagtgcaggcagccgggagagccatggcgggggccgcagcgggcggcagaggcggaggtgcctgggggccggggcgcggaggggccggggggctccggcggggctgctctcccccagcccccgccggctccccccgggctgggctgcagccgctcagggccacgatccccttccagctgcagcagccgcaccagcgccgggacgggggtggccgtgcagccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccccagaaggctgtgagaaagtgcgtgtgtttgaagaagccacgtctccaggtcctgacctggccttcctgacttcctgtcctgacaagaacaaagtccatttcaacccgactggctcagccttctgccccgtcaacctgatgaagcccctcttccccggcatgggcttcatcttccgtaactgcccctcaaacccgggatctccccttcccccggccagccccaggccaccacctcggaaggatccggaagcctccaaggcctccccactgccattcgagccatggcagcgcaccccaccatcagaagagcctgtgcttttccagagctccctgatggtctgagggtcccacccctgccccactttaccatagagaccagtgccttggtggcaggtccctccccaggtcccctgagatggggtatggaggggcccttccctctcggccttcgagcactttctttcacttactgtgtcaaagccctgggtcctctttttgatgggcaccggcccctctgaacgtgatgggacctgccttctccactagtagctgggcagctcacaattcacacctgtgtacctgccacatccctcacttggtggaaaacacccagaaggtcttgagtcccccacccctgggtgtcagtccaaatgactgtataggaggcccttatttttgtcacagagcaagctggccatgaacgaaggagagaagacgccacagatttccttccctctcctccaggagaccataagatagatcccccatcctctcagccctattcccatgcctccctctcattggaggagctgaccaaagcagccctaacgggccataacacttgaccaattcagctgctggcagagggaggaaacaagtgttttcccaagtggcattttcatctcgctttcaccctgactaaagattgtcttaagtagcagcccagcccgcccagccccaggtgggtagtggggaggagagctggcattcctccaggtggcaaatggcgactctatactctccgcccgccccagggctggatggattagaaaaatgcctatttttcttgtatcgatgtagagactctattttctcccaaagacactatttttgcagctgtttgaagtttgtatattttccgtactgcagagcttacacaaaattgaagaatgttaatgttcgagttttcttatcttgtgtttagaggtgtgggtgcagtctcgggtatatacaacctcacgggncattgtactaatattccccagcgc

SEQ ID NO: 418961 - DNA, 511 bp, Homo sapiens
aaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattattttttattttttttgtttttttaatgaaccctctcgttttacttggatgtgatcagctgtaagtaaaataaaagcaaaacaaaaaagaggcgaagatcgagtaggaactgcaggggaaatggaaagtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaac

SEQ ID NO: 418962 - DNA, 449 bp, Homo sapiens
tcacgattctttgcctgttctattgttttgcttttattttacttacagtctgatcactatccaagtaaaacgagagggttcattaataaaaacaaaaagaaataaaaaataatcctctaactttattgggtgaaaataaaaacgctggagcagaaagtggggggcatggagcggtcctcgggggtccgggaggagttaatagcatgtgccgaccgcggtctcgctgtcaggttgtgaaggggtagaccccgaggaggaaaggaaatggaaagtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaac

SEQ ID NO: 418963 - DNA, 530 bp, Homo sapiens
gatatttaaaagataggagatagtacagcacgtttgtacgctgatggtaatgattaagtaaagaatgagaacgggatgattcagaagaaagggcataacttgaggagtgaaaccctgcaacctgttttcaaggccgggcaggagaaggaatgcttacaacggaggggaggcagaggtgtgggcacagatgcaggcgggccggcggatctggggaggaaggatgaagggagttctcttctctttgtttctaatttttcagaaagcaggaagccaagtcaccaggcagaactgatagcatgggaagtgggttcccaccagtcgcatgcagctgctctggtatggccatggtgctggggatgagtcagaaatctcaggtaggtacaacagaggaacaggcagatatggtagttaagggtattttgaaagaattattatatttgataatttgagctgcttaaggagggaagaaaggacatgagaggggtacggtaaaaaaggcagggaggtctccatgtggccagagaattact

SEQ ID NO: 418964 - DNA, 558 bp, Homo sapiens
ctagatttggaaatctctgtctacgtgtatgaaaggagggaagcagctataaattagaaaggagataggaaagtgaagatatttactagactctgcctttgcttgcagttctctggcttgattgaggaggttctcactttcatctttatgggactttggctaaaaaaataaactgtcaaaggaactggcatttgctgactggactacagcacatctcgaagaatctgcagactgaaaccttcaaggcattcatgaaatggtcttcccttagttcccctgccttttccactctttctgccatttggatttcacactggaagttcaagagatgacatcagaaaacagaaaagccagtgggaaaggcaaggagatttggaagagtgtttgaaaattttggcaatcaagaataagaaggtgttgaaatcaaatagttcctgctgggcactgtggagtatttatcagaagtcagttatattgccaattcccgaccagttttacttaagacacttgggtgtggaaagataatgctgtctatgaaataaataggtaatgttagaa

SEQ ID NO: 418965 - DNA, 941 bp, Homo sapiens
ctagatttggaaatctctgtctacgtgtatgaaaggagggaagcagctataaattagaaaggagataggaaagtgaagatatttactagactctgcctttgcttgcagttctctggcttgattgaggaggttctcactttcatctttatgggactttggctaaaaaaataaactgtcaaaggaactggcatttgctgactggactacagcacatctcgaagaatctgcagactgaaaccttcaaggcattcatgaaatggtcttcccttagttcccctgccttttccactctttctgccatttggatttcacactggaagttcaagagatgacatcagaaaacagaaaagccagtgggaaaggcaagaaagcaggaagccaagtcaccaggcagaactgatagcatgggaagtgggttcccaccagtcgcatgcagctgctctggtatggccatggtgctggggatgagtcagaaatctcagtcttttctggcttaaagaaaaggaagaatggaacccatcttctccagatatgttgttatggggtaggtgtaggtctagagacagaaaagaatcacatttgaacatcctcttaatgcaagaacatttttaaagaaacaattttccctgaatatccatcaagcctaatacagtgtgactatctgagatcaattattcttatctttacaaagactgggagttatacagcaaaagcaatactgtaaaatatgtgtattaaaatatgtaaaagaagggagttgaaaaaaggttggtattatttacctctcacagaactgttttccttttacagtgttctttaccccttctgtaagttctctctgggtgactgcgggagaacactgctaacaccctgaagtcagagacaaacttcaaagctgtgtgctaatagcactgtatataagcttatttgcagtagatgaa

SEQ ID NO: 418966 - DNA, 684 bp, Homo sapiens
tctagatgaactttctcttttgagctcctcttttggaaaaagaaacagtcctccctggcctccccacccggttccgcgtccttagacagctctcccggaacggagctcccagtgccctccttggcctcctcagcacccctggcacccaccaagcctcacccccggcccagggtgagtcgtctgcgcctgcgcactcgcgcgtgggcctgagctcccaggagtctccggggcggcccgttagtcgccgcgcggtgctagctgccggcgctcccctccgtttgcacccacggccgccctattgcggctggcactacgcttctgccaggaccccggctcccttttccgttgacctggtgttcgttttccatgtggtgagttgaggtgacccgggtctggatgcgagaagagctcacggcaggggacctgggttcatgggacgcggagagggtttgtggaggcagaagccccaggcctgtgtgcaagtcacctgctggggagggagactgtgtgattgtgtttgtgtgtgccgttctgtggctgcgtccgtgtgtggtggtgtgagtgggcgcgcctgtgatggtcccgggggggcggggggtgtgcacagcagggggtgtgtgtgcacagcaggtgcacagcccgggacagccctgactgtccccgattgggcccgcgggactgagt

SEQ ID NO: 418967 - DNA, 2801 bp, Homo sapiens
atacagactttctgtttttctatttcattttgagtcaagagttttgagaagctgtgcttttaaaggaatggatgaatttcatctaaaatgtcaaatttattggcataaaattgttcataatattgccttatcattttactgtctataggatccgtagtggcatcttcatttttattcctgacatgggcaatttgtgttttctattttattaattatgcttactagggatttatccatttttaaaataccttcacataaacttgttgttttgttcattttcttaatggtctgctttctatttctatttaattgatttatgctcatcttttttttttttttttttttaagatggagtctcgctctgtcacccagcctggagtgcagtggcgcgatctcggctcactgcaagctcctcctcccggatttaggccattctcctgcctcagcctcccgagtagctgggactacaggcggcgcctgccacaactcctggctaattttttgcatttttagtagagatggggtttcaccatgttagtcaggatggtctcgatctcctgacctcgtgatctgcccgtctcagcctcccacagtgctgggattacaggcgtgagccaccgcgcccagccgatttatgcccatctttacttcttttttttgacttttggtttagcatatagcatgtttattattcttgtttaagcctttcctcatttttaaaaatggtggcaaagtatacatgtaacataaaatttaccatcttaactatttgagtatacagctcagcagcattaagtatattcccatttttgtacaaccaacatccacaactttttcatcctgtaaatgtgaaactatatccatgaaataataactacccttttccccctgcccccagcccctggcaaccacgacaagaaacctacaaactctcactacaagcgttaatagcctaaaagtgggagaccagtaatactttctgattttatgaggtggactactctagatacttcatatgagtggaatcataagtagttatctttttgtgattggcttattagaatatcctcaaggttcagccacattgtagcatatgtcaaaatttccttccaaggctgaataatattacattgtatgtatatgccacatgtattagtctgttttgtgttgctataaaggaatacctgaggctgggtaatttataaagaaaaatggtttatttagcttatggttctataggctgtacaagaagcatagtgccagcatctgcttctggtgaggcctcaggaagcttacaattatggcagaaggcaaagggagagctagcatatcacatggcaagagggaacaaaagggagagggaggaggtgccaggctcttttaaacaactagctataggatgaactcatatccatgtggaggacaccaagccattcatgagatccaccccataatccaacacctcccactaggcgccacctccaacactgggggtcacatgtccgtgtgagattttgagggaacaaatatccaaatcatattaccacattttgtttatccattcatccactgatgaacatctgggttgtacgtatttcttggttattgtgaataatgctgctatgaatttctcctttttttatttaagtacttaacattcctctcaactctgctttagctgtatccttccaattttgatatgctgttgtcactttttcatatttcaaaacattttccccttatttattcaatgatctgtagatctagaagtgtgttatttaatttccatgtattgaaggactgtataggtttcttattattggtttctaatgcacattccctgtaatgtggcaatcttttgaagtttattgtgacttatggtccagccaatagtctatcatggggactgttcaggtacatgaaaagaatgtaatttttcaattgtgggtatggtgttctgtaaacaacaattaggtcatgttgactggtgtggttcatatcttctatacagttgtcccttgctatccacaggggactggttccaggacaccttgtggataccaaaacctacagatgcccaagtttgttatataaaatggtgtagtagttgcatataacctatgcacaaccttctgtatattttaaaccatctctagattttttataatacttaatacaatgtaaatgctatgtaaataattttatactgtattttaaaatttgtatttttttactgtcattgtgttttttctgaatatttgtgcattgctattggttgaatctgcatatatgaagagctgattacatatactactaaatttcttgcctacaagtgctatcaattactgagatataattgtggatttccaattatgcttgtggatctatttcttttgttctgttagtttttgcttcataaaatttaacactctcattataggttcatactagcatacatattcctgatgaacacagtcatgtgtcatgtaataacattttactcaatgatggacacatatacaatggtggtcccataagattacaatggagctgaaaaattcctatcacttgtggacgttgtcatgcaacatatcactcaggtgtttgtggtgacgctgctgtaaataaacctactgtgcttccagttgtataaaagtatagcacatgcaattatgtatagtacgtaataggtgataataataagtgattacattactagtttatgtaatttattgtactatttgtattattattttagactgtactccttctacttattaaaaaaaaaagtaactgtaaaa

SEQ ID NO: 418968 - DNA, 2911 bp, Homo sapiens
tctagatgaactttctcttttgagctcctcttttggaaaaagaaacagtcctccctggcctccccacccggttccgcgtccttagacagctctcccggaacggagctcccagtgccctccttggcctcctcagcacccctggcacccaccaagcctcacccccggcccagggtgagtcgtctgcgcctgcgcactcgcgcgtgggcctgagctcccaggagtctccggggcggcccgttagtcgccgcgcggtgctagctgccggcgctcccctccgtttgcacccacggccgccctattgcggctggcactacgcttctgccaggaccccggctcccttttccgttgacctggtgttcgttttccatgtgttgctgagagatggatgttaaaaatcaacaccaggactacagtaaggctgaaatcattgaagtgcttggagtgcagaactgaaagagatggagtctcgctctgtcacccagcctggagtgcagtggcgcgatctcggctcactgcaagctcctcctcccggatttaggccattctcctgcctcagcctcccgagtagctgggactacaggcggcgcctgccacaactcctggctaattttttgcatttttagtagagatggggtttcaccatgttagtcaggatggtctcgatctcctgacctcgtgatctgcccgtctcagcctcccacagtgctgggattacaggcgtgagccaccgcgcccagccgatttatgcccatctttacttcttttttttgacttttggtttagcatatagcatgtttattattcttgtttaagcctttcctcatttttaaaaatggtggcaaagtatacatgtaacataaaatttaccatcttaactatttgagtatacagctcagcagcattaagtatattcccatttttgtacaaccaacatccacaactttttcatcctgtaaatgtgaaactatatccatgaaataataactacccttttccccctgcccccagcccctggcaaccacgacaagaaacctacaaactctcactacaagcgttaatagcctaaaagtgggagaccagtaatactttctgattttatgaggtggactactctagatacttcatatgagtggaatcataagtagttatctttttgtgattggcttattagaatatcctcaaggttcagccacattgtagcatatgtcaaaatttccttccaaggctgaataatattacattgtatgtatatgccacatgtattagtctgttttgtgttgctataaaggaatacctgaggctgggtaatttataaagaaaaatggtttatttagcttatggttctataggctgtacaagaagcatagtgccagcatctgcttctggtgaggcctcaggaagcttacaattatggcagaaggcaaagggagagctagcatatcacatggcaagagggaacaaaagggagagggaggaggtgccaggctcttttaaacaactagctataggatgaactcatatccatgtggaggacaccaagccattcatgagatccaccccataatccaacacctcccactaggcgccacctccaacactgggggtcacatgtccgtgtgagattttgagggaacaaatatccaaatcatattaccacattttgtttatccattcatccactgatgaacatctgggttgtacgtatttcttggttattgtgaataatgctgctatgaatttctcctttttttatttaagtacttaacattcctctcaactctgctttagctgtatccttccaattttgatatgctgttgtcactttttcatatttcaaaacattttccccttatttattcaatgatctgtagatctagaagtgtgttatttaatttccatgtattgaaggactgtataggtttcttattattggtttctaatgcacattccctgtaatgtggcaatcttttgaagtttattgtgacttatggtccagccaatagtctatcatggggactgttcaggtacatgaaaagaatgtaatttttcaattgtgggtatggtgttctgtaaacaacaattaggtcatgttgactggtgtggttcatatcttctatacagttgtcccttgctatccacaggggactggttccaggacaccttgtggataccaaaacctacagatgcccaagtttgttatataaaatggtgtagtagttgcatataacctatgcacaaccttctgtatattttaaaccatctctagattttttataatacttaatacaatgtaaatgctatgtaaataattttatactgtattttaaaatttgtatttttttactgtcattgtgttttttctgaatatttgtgcattgctattggttgaatctgcatatatgaagagctgattacatatactactaaatttcttgcctacaagtgctatcaattactgagatataattgtggatttccaattatgcttgtggatctatttcttttgttctgttagtttttgcttcataaaatttaacactctcattataggttcatactagcatacatattcctgatgaacacagtcatgtgtcatgtaataacattttactcaatgatggacacatatacaatggtggtcccataagattacaatggagctgaaaaattcctatcacttgtggacgttgtcatgcaacatatcactcaggtgtttgtggtgacgctgctgtaaataaacctactgtgcttccagttgtataaaagtatagcacatgcaattatgtatagtacgtaataggtgataataataagtgattacattactagtttatgtaatttattgtactatttgtattattattttagactgtactccttctacttattaaaaaaaaaagtaactgtaaaa

SEQ ID NO: 418969 - DNA, 3228 bp, Homo sapiens
atacagactttctgtttttctatttcattttgagtcaagagttttgagaagctgtgcttttaaaggaatggatgaatttcatctaaaatgtcaaatttattggcataaaattgttcataatattgccttatcattttactgtctataggatccgtagtggcatcttcatttttattcctgacatgggcaatttgtgttttctattttattaattatgcttactagggatttatccatttttaaaataccttcacataaacttgttgttttgttcattttcttaatggtctgctttctatttctatttaattgatttatgctcatcttttttttttttttttttttaagatggagtctcgctctgtcacccagcctggagtgcagtggcgcgatctcggctcactgcaagctcctcctcccggatttaggccattctcctgcctcagcctcccgagtagctgggactacaggcggcgcctgccacaactcctggctaattttttgcatttttagtagagatggggtttcaccatgttagtcaggatggtctcgatctcctgacctcgtgatctgcccgtctcagcctcccacagtgctgggattacaggcgtgagccaccgcgcccagccgatttatgcccatctttacttcttttttttgacttttggtttagcatatagcatgtttattattcttgtttaagcctttcctcatttttaaaaatggtggcaaagtatacatgtaacataaaatttaccatcttaactatttgagtatacagctcagcagcattaagtatattcccatttttgtacaaccaacatccacaactttttcatcctgtaaatgtgaaactatatccatgaaataataactacccttttccccctgcccccagcccctggcaaccacgacaagaaacctacaaactctcactacaagcgttaatagcctaaaagtgggagaccagtaatactttctgattttatgaggtggactactctagatacttcatatgagtggaatcataagtagttatctttttgtgattggcttattagaatatcctcaaggttcagccacattgtagcatatgtcaaaatttccttccaaggctgaataatattacattgtatgtatatgccacatgtattagtctgttttgtgttgctataaaggaatacctgaggctgggtaatttataaagaaaaatggtttatttagcttatggttctataggctgtacaagaagcatagtgccagcatctgcttctggtgaggcctcaggaagcttacaattatggcagaaggcaaagggagagctagcatatcacatggcaagagggaacaaaagggagagggaggaggtgccaggctcttttaaacaactagctataggatgaactcatatccatgtggaggacaccaagccattcatgagatccaccccataatccaacacctcccactaggcgccacctccaacactgggggtcacatgtccgtgtgagattttgagggaacaaatatccaaatcatattaccacattttgtttatccattcatccactgatgaacatctgggttgtacgtatttcttggttattgtgaataatgctgctatgaatttctcctttttttatttaagtacttaacattcctctcaactctgctttagctgtatccttccaattttgatatgctgttgtcactttttcatatttcaaaacattttccccttatttattcaatgatctgtagatctagaagtgtgttatttaatttccatgtattgaaggactgtataggtttcttattattggtttctaatgcacattccctgtaatgtggcaatcttttgaagtttattgtgacttatggtccagccaatagtctatcatggggactgttcaggtacatgaaaagaatgtaatttttcaattgtgggtatggtgttctgtaaacaacaattaggtcatgttgactggtgtggttcatatcttctatacagttgtcccttgctatccacaggggactggttccaggacaccttgtggataccaaaacctacagatgcccaagtttgttatataaaatggtgtagtagttgcatataacctatgcacaaccttctgtatattttaaaccatctctagattttttataatacttaatacaatgtaaatgctatgtaaataattttatactgtattttaaaatttgtatttttttactgtcattgtgttttttctgaatatttgtgcattgctattggttgaatctgcatatatgaagagctgattacatatactactaaatttcttgcctacaagtgctatcaattactgagatataattgtggatttccaattatgcttgtggatctatttcttttgttctgttagtttttgcttcataaaatttaacactctcattataggttcatactagcatacatattcctgatgaacacagtcatgtgtcatgtaataacattttactcaatgatggacacatatacaatggtggtcccataagattacaatggagctgaaaaattcctatcacttgtggacgttgtcatgcaacatatcactcaggtgtttgtggtgacgctgctgtaaataaacctactgtgcttccagttgtataaaagtatagcacatgcaattatgtatagtacgtaataggtgataataataagtgattacattactagtttatgtaatttattgtactatttgtattattattttagactgtactccttctacttattaaaaaaaaaagtaactgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggggaaaacgggggggacaacagcaaccacccacacaccacactgtgaaagaaaggaacgagtcgcacactacagaggagtgtgagaaaaaaaaaaagaaagagaacgacgggacgacttaaaaaagacgcactaggaagagaagaacaaacgccagaatactgaacagagagaaaccacaccttggcggggagaaaaaacgagccacccacaacgaaagaaacccagcgaggaaaaaaaaccaggaggagcggagaaacccaactgctacgcgacagaaagcgccatgagtaaaaaaaacg

SEQ ID NO: 418970 - DNA, 2747 bp, Homo sapiens
atacagactttctgtttttctatttcattttgagtcaagagttttgagaagctgtgcttttaaaggaatggatgaatttcatctaaaatgtcaaatttattggcataaaattgttcataatattgccttatcattttactgtctataggatccgtagtggcatcttcatttttattcctgacatgggcaatttgtgttttctattttattaattatgcttactagggatttatccatttttaaaataccttcacataaacttgttgttttgttcattttcttaatggtctgctttctatttctatttaattgatttatgctcatcttttttttttttttttttttaagatggagtctcgctctgtcacccagcctggagtgcagtggcgcgatctcggctcactgcaagctcctcctcccggatttaggccattctcctgcctcagcctcccgagtagctgggactacaggcggcgcctgccacaactcctggctaattttttgcatttttagtagagatggggtttcaccatgttagtcaggatggtctcgatctcctgacctcgtgatctgcccgtctcagcctcccacagtgctgggattacaggcgtgagccaccgcgcccagccgatttatgcccatctttacttcttttttttgacttttggtttagcatatagcatgtttattattcttgtttaagcctttcctcatttttaaaaatggtggcaaagtatacatgtaacataaaatttaccatcttaactatttgagtatacagctcagcagcattaagtatattcccatttttgtacaaccaacatccacaactttttcatcctgtaaatgtgaaactatatccatgaaataataactacccttttccccctgcccccagcccctggcaaccacgacaagaaacctacaaactctcactacaagcgttaatagcctaaaagtgggagaccagtaatactttctgattttatgaggtggactactctagatacttcatatgagtggaatcataagtagttatctttttgtgattggcttattagaatatcctcaaggttcagccacattgtagcatatgtcaaaatttccttccaaggctgaataatattacattgtatgtatatgccacatgtattagtctgttttgtgttgctataaaggaatacctgaggctgggtaatttataaagaaaaatggtttatttagcttatggttctataggctgtacaagaagcatagtgccagcatctgcttctggtgaggcctcaggaagcttacaattatggcagaaggcaaagggagagctagcaaaacaactagctataggatgaactcatatccatgtggaggacaccaagccattcatgagatccaccccataatccaacacctcccactaggcgccacctccaacactgggggtcacatgtccgtgtgagattttgagggaacaaatatccaaatcatattaccacattttgtttatccattcatccactgatgaacatctgggttgtacgtatttcttggttattgtgaataatgctgctatgaatttctcctttttttatttaagtacttaacattcctctcaactctgctttagctgtatccttccaattttgatatgctgttgtcactttttcatatttcaaaacattttccccttatttattcaatgatctgtagatctagaagtgtgttatttaatttccatgtattgaaggactgtataggtttcttattattggtttctaatgcacattccctgtaatgtggcaatcttttgaagtttattgtgacttatggtccagccaatagtctatcatggggactgttcaggtacatgaaaagaatgtaatttttcaattgtgggtatggtgttctgtaaacaacaattaggtcatgttgactggtgtggttcatatcttctatacagttgtcccttgctatccacaggggactggttccaggacaccttgtggataccaaaacctacagatgcccaagtttgttatataaaatggtgtagtagttgcatataacctatgcacaaccttctgtatattttaaaccatctctagattttttataatacttaatacaatgtaaatgctatgtaaataattttatactgtattttaaaatttgtatttttttactgtcattgtgttttttctgaatatttgtgcattgctattggttgaatctgcatatatgaagagctgattacatatactactaaatttcttgcctacaagtgctatcaattactgagatataattgtggatttccaattatgcttgtggatctatttcttttgttctgttagtttttgcttcataaaatttaacactctcattataggttcatactagcatacatattcctgatgaacacagtcatgtgtcatgtaataacattttactcaatgatggacacatatacaatggtggtcccataagattacaatggagctgaaaaattcctatcacttgtggacgttgtcatgcaacatatcactcaggtgtttgtggtgacgctgctgtaaataaacctactgtgcttccagttgtataaaagtatagcacatgcaattatgtatagtacgtaataggtgataataataagtgattacattactagtttatgtaatttattgtactatttgtattattattttagactgtactccttctacttattaaaaaaaaaagtaactgtaaaa

SEQ ID NO: 418971 - DNA, 2232 bp, Homo sapiens
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtg

SEQ ID NO: 418972 - DNA, 2961 bp, Homo sapiens
  misc_feature (2255)..(2255): n is a, c, g, or t
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418973 - DNA, 2770 bp, Homo sapiens
  misc_feature (2255)..(2255): n is a, c, g, or t
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaggggggggcgccgcccaaataagaatttcccccgggggggccccaatttttagcgccttatcccccggttttttttgtgttacccaggggggggccccctatgagggggaggccgtctattatatatagccatgggccagcgggccgcgcggcttttaaccaccgcggctgtggacgctggagaacaaaacctcgctcaagcgcgtgggggacacccttggggggagggggaccccctttatctctccgcggggggcggggggcggcccacattttgtgcggggcccacacacctccccctttagcgaggggggcttttttaaaggggcccctcaaagggggccccctattacttacacctttttcacgggggtctcctttaagcgggcgggcttcaaccctgtccggcgcgcaaataattcttgctgccgcgcgctttgagaaaaaccttctggcgcctccaccggggcgttcttgctctcttccgcacactttttttcttccgtg

SEQ ID NO: 418974 - DNA, 2098 bp, Homo sapiens
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagtgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtg

SEQ ID NO: 418975 - DNA, 5593 bp, Homo sapiens
  misc_feature (2786)..(2786): n is a, c, g, or t
  misc_feature (3009)..(3009): n is a, c, g, or t
  misc_feature (4887)..(4887): n is a, c, g, or t
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagtgaggacctgagtcctgaaccaggcccccagcccgccctctcatgtcctctccaggtcccccaaactctcatttcccagggtagttcctgaagtacctctgaaaagctacacaggcataaagagtaaggaatagtttctcaaaactggaacgggagcctcactgtgccaggttcagaagtaatttataaaacagcaataattaaaacacataatactggtgattcttaataggactgtacaaggacagtagcttcctttttcacttacttttgcctcctttctggagcattgggttttgtgatgattcatagactctttaaggtagggaaagggtttggcaacgttaggcttttgaagctaggaagatagcagagctggagtagatggtgttttgcttccttgggaggggtaaagaggtacagttaattaaatttttttatttctatttttattaaaatttatttttattttctattatttttctaaggagaagataatattagtgcttcctattaggtgccaggcatagcactaaagcacttgcctttctttggtgtagggggagactagtagtaaagtaaaagacctctgaggaagaggttgtaccatatcccaaacggccaaacttaaaaacctttcagtactttagttgattcctatattttcaaacatacggtgaatagtttcacttattttcagcaccattatttgtaccaccttcaaaatctctatttcagacatcctaactgcatattctataggtttttctgttattattcttttaaatcttctcctttggaaaatttcaaacccaaacccaaacagaatagtgtaataatcccctgtacacaccctgcagccttttttttttttttttaagagacagactgttgctctgtcagctatgccggagtgcagtggcatgatcatggctcattgcagtctcagactgctcggctcaagcaatcctcctacctccgcttccctaggactgcaggcatgaaccgccatgcctttaattttttcacagaggcagggtcttgttatgttgcacaggctggtctcaaactcctggcctcaagcgattctcctgcctcagtctcctaaagtgctgggattataggtgtaagccgctgcctgctggcatatcttaaagcaaatcttagacattgcatcaattaacctttaaatactttaaggatttttaaaaatgtaaccatatcattaccacttctgttttcccctgtggtcttaaaaatgtctttttataactggtttgtttaaattgggataaacaaggttctcacattgcatttgctttatactaagttcctctcttgggtgggcacagtggtgcacacctgtaatctcagcactttgggaggccaacacagaaggaccacttgagtccaggagttcgaaaccagcctggacaacattgtgaggctccccctacctatacaaaaaaantttttttttttttttttttttttttttgagacggatcctcactctgtcacccaggctggagtgcagtggcgcgatcttagctcactgcaacctccacctcccgggttcaagcgattctcctgcctccacctcccgagtagctgggactacaggcgcgtgccaccacgcctggctaattttttctgtttttagtagagatgcggtttcactgtgttagccaggntggtctcgatcttctgaccttgtgatctgcccgccttggcctcccaaagtgctgggattaaaataaattgtttttaattagctgggggtggtgttgcacgcctgtagtcccagctactcaagaggctgaggtgggaggatcgcttgaacccaggaggtcaaggctatagtgagccatgatcatactattgcacttcagcatgggcgacagtgtgagaccctgtcacgaaaaaaaaaaaagtttctttttctttaaaattactagactattcttagagcagttttaggtttacagaaaaactgagcacaaagcacagagttcccatatactccctgtctccacacccagaatgtcccttattataaatgtcttgtctttggtgtggtactcttcagtctctcttcatctgtagcagtgcccatgccttttttttttttttttaatgtcatttatttgttgaagaaactgggtcatttgttgtgtagaatgttccacattctgggtttgtccttgtgctagtgtttaacacacccctcctctcctatatttcttgtgtgttggtggttagatttagaaacctgattagattcatgtcccacatttttggcaagaaaaattcccaggtggttctgtgaacttcttcttgcgtcacatcaggcacttggtgtctggtgccccagttgtagtgatgtgaagattgattagccatctgcagcactcctaacaacctctcttgatcgcatcctgggatcactgccctggaaacatcctctcccttttcttagcccctgctttcttcccttgcctgcctggcttctatgctcccaagcccatcttctaggcacccagattgaggctccatggcaagcagcagggacaggggcagcaggtagcctgaccccaggaaagagatgtgggtgaccttgcatgtctccaggttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418976 - DNA, 2760 bp, Homo sapiens
  misc_feature (2054)..(2054): n is a, c, g, or t
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatggttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418977 - DNA, 5509 bp, Homo sapiens
  misc_feature (2786)..(2786): n is a, c, g, or t
  misc_feature (3009)..(3009): n is a, c, g, or t
  misc_feature (4803)..(4803): n is a, c, g, or t
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagtgaggacctgagtcctgaaccaggcccccagcccgccctctcatgtcctctccaggtcccccaaactctcatttcccagggtagttcctgaagtacctctgaaaagctacacaggcataaagagtaaggaatagtttctcaaaactggaacgggagcctcactgtgccaggttcagaagtaatttataaaacagcaataattaaaacacataatactggtgattcttaataggactgtacaaggacagtagcttcctttttcacttacttttgcctcctttctggagcattgggttttgtgatgattcatagactctttaaggtagggaaagggtttggcaacgttaggcttttgaagctaggaagatagcagagctggagtagatggtgttttgcttccttgggaggggtaaagaggtacagttaattaaatttttttatttctatttttattaaaatttatttttattttctattatttttctaaggagaagataatattagtgcttcctattaggtgccaggcatagcactaaagcacttgcctttctttggtgtagggggagactagtagtaaagtaaaagacctctgaggaagaggttgtaccatatcccaaacggccaaacttaaaaacctttcagtactttagttgattcctatattttcaaacatacggtgaatagtttcacttattttcagcaccattatttgtaccaccttcaaaatctctatttcagacatcctaactgcatattctataggtttttctgttattattcttttaaatcttctcctttggaaaatttcaaacccaaacccaaacagaatagtgtaataatcccctgtacacaccctgcagccttttttttttttttttaagagacagactgttgctctgtcagctatgccggagtgcagtggcatgatcatggctcattgcagtctcagactgctcggctcaagcaatcctcctacctccgcttccctaggactgcaggcatgaaccgccatgcctttaattttttcacagaggcagggtcttgttatgttgcacaggctggtctcaaactcctggcctcaagcgattctcctgcctcagtctcctaaagtgctgggattataggtgtaagccgctgcctgctggcatatcttaaagcaaatcttagacattgcatcaattaacctttaaatactttaaggatttttaaaaatgtaaccatatcattaccacttctgttttcccctgtggtcttaaaaatgtctttttataactggtttgtttaaattgggataaacaaggttctcacattgcatttgctttatactaagttcctctcttgggtgggcacagtggtgcacacctgtaatctcagcactttgggaggccaacacagaaggaccacttgagtccaggagttcgaaaccagcctggacaacattgtgaggctccccctacctatacaaaaaaantttttttttttttttttttttttttttgagacggatcctcactctgtcacccaggctggagtgcagtggcgcgatcttagctcactgcaacctccacctcccgggttcaagcgattctcctgcctccacctcccgagtagctgggactacaggcgcgtgccaccacgcctggctaattttttctgtttttagtagagatgcggtttcactgtgttagccaggntggtctcgatcttctgaccttgtgatctgcccgccttggcctcccaaagtgctgggattaaaataaattgtttttaattagctgggggtggtgttgcacgcctgtagtcccagctactcaagaggctgaggtgggaggatcgcttgaacccaggaggtcaaggctatagtgagccatgatcatactattgcacttcagcatgggcgacagtgtgagaccctgtcacgaaaaaaaaaaaagtttctttttctttaaaattactagactattcttagagcagttttaggtttacagaaaaactgagcacaaagcacagagttcccatatactccctgtctccacacccagaatgtcccttattataaatgtcttgtctttggtgtggtactcttcagtctctcttcatctgtagcagtgcccatgccttttttttttttttttaatgtcatttatttgttgaagaaactgggtcatttgttgtgtagaatgttccacattctgggtttgtccttgtgctagtgtttaacacacccctcctctcctatatttcttgtgtgttggtggttagatttagaaacctgattagattcatgtcccacatttttggcaagaaaaattcccaggtggttctgtgaacttcttcttgcgtcacatcaggcacttggtgtctggtgccccagttgtagtgatgtgaagattgattagccatctgcagcactcctaacaacctctcttgatcgcatcctgggatcactgccctggaaacatcctctcccttttcttagcccctgctttcttcccttgcctgcctggcttctatgctcccaagcccatcttctaggcacccagattgaggctccatggcaagcagcagggacaggggcagcaggtagcctgaccccaggaaagagatgtgggtgaccttgcatgtctccaggttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcaggttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418978 - DNA, 1709 bp, Homo sapiens
  misc_feature (1676)..(1676): n is a, c, g, or t
  misc_feature (1680)..(1680): n is a, c, g, or t
  misc_feature (1682)..(1683): n is a, c, g, or t
  misc_feature (1687)..(1688): n is a, c, g, or t
  misc_feature (1690)..(1690): n is a, c, g, or t
  misc_feature (1697)..(1697): n is a, c, g, or t
  misc_feature (1700)..(1700): n is a, c, g, or t
  misc_feature (1707)..(1707): n is a, c, g, or t
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcaagcaggtttgagaagtgtggttttcngggngnnttcnnanaaatccnganggtttcntt

SEQ ID NO: 418979 - DNA, 2079 bp, Homo sapiens
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctattgccttggacttaacacgtggtgttccttatcagctggctgctgtcctttgacttccaccagatggtgtgcttcctggaggcacaggttctgtctttcattaagacctgacccatctcaggacatgacaaaggaaatatcttgtttttgatttcttggaagaggaagcactctgggccagaggtatgagccgggatgaagtggactccttgtctggaggtggtgctacacaccttggaggggctcctgggagctactgagaatgtcccctaagtcagtattcctgcctcagctgaaatgccagtcttcagcctcatctactgcacacttgagtccatgagattttagagtgaaatgaaatcttgttatgttgtccagggtggtcttcaacacctagcctcaagcaatcctcccaccttggcctcccaaagcactgggattacaggtgtgaacactgaaccactgaacccagcctaatgtcttattttattaaagtttttgttttttaagctga

SEQ ID NO: 418980 - DNA, 1761 bp, Homo sapiens
  misc_feature (1659)..(1659): n is a, c, g, or t
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctttttggctataggctgggactaacccgtgttccttataagtgggggcgggcctggagtccaccaaagggtggcttccggagggacggtcgggctncataagaacggccactcgggatagaaggcccggcgcagttaacggggaatgaccatggggggggcgcacccgtggggcggggcatagaggcacaccccggag

SEQ ID NO: 418981 - DNA, 2972 bp, Homo sapiens
  misc_feature (2266)..(2266): n is a, c, g, or t
aggttcgggagacatccggaagagggaccagtctttctttccctgccccgtgatgaaggcatcaaatacaactgacagggtctgcctcagctcccaggagatgctagtacagcgtgcatttctgcaaacagggcggatatgcactgcctgggagtggtagctggtgtggaacaagcgatctgccttcagcagcacagagaggcctgctttggaactacagggcaagagcttattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418982 - DNA, 2724 bp, Homo sapiens
  misc_feature (2018)..(2018): n is a, c, g, or t
catgggtaaccgttcgtacgagaatcgctgtcctctccttgcggccgccagtgtggtggaattcgcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418983 - DNA, 2678 bp, Homo sapiens
  misc_feature (1972)..(1972): n is a, c, g, or t
acggatagcggatctgcacacaaggcttttggaggacccgatactggacggatagcgaatctgcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418984 - DNA, 1649 bp, Homo sapiens
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgggtgagtgggtggttggttggactgctgggttgcaacggctacagagaaaagactcacaatcccacgtctttgccgttagatgattgggttgtatttagaccagatttccagagtcatatgctgctgactgtagctattccaagctctacgattttgggtaggttcctaaactccccaagcttcagcatccacatctgaaaaatagagtatacttagcaaattggatgagatgatgtgaaaaatggagttagttcatgcatttgcttaatcaaccaaatacttttgaattcatactaagtgccaggcatagagtgttgaataagacagaggacactgcactcaagaaatataagtctactagctagggcaggtgtcagttaattaattacagttgtgttcagttcccttaccaagggaaagagcagaatatcctgagaggacctggattgggttcgaagggggcacggtgttcgtcacgtaagcacttctatactagcaacctattgtcatcatcgcttgttgctggggaagacag

SEQ ID NO: 418985 - DNA, 2629 bp, Homo sapiens
  misc_feature (1923)..(1923): n is a, c, g, or t
catgggtaaccgttcgtacgagaatcgctgtcctctccttgcggccgccagtgtggtggaattcgcagatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418986 - DNA, 2783 bp, Homo sapiens
  misc_feature (2077)..(2077): n is a, c, g, or t
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418987 - DNA, 2655 bp, Homo sapiens
  misc_feature (1949)..(1949): n is a, c, g, or t
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418988 - DNA, 2833 bp, Homo sapiens
  misc_feature (2127)..(2127): n is a, c, g, or t
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgaacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418989 - DNA, 2788 bp, Homo sapiens
  misc_feature (2082)..(2082): n is a, c, g, or t
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418990 - DNA, 2860 bp, Homo sapiens
  misc_feature (2154)..(2154): n is a, c, g, or t
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418991 - DNA, 2864 bp, Homo sapiens
  misc_feature (2158)..(2158): n is a, c, g, or t
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgaacactgaccactactttctgcgctatgctgtgctgccgcgggaggtggtctgcaccgaaaacctcaccccctggaagaagctcttgccctgtagttccaagggcttctcttatctctttccatctcctccaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418992 - DNA, 2557 bp, Homo sapiens
  misc_feature (1851)..(1851): n is a, c, g, or t
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgaactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418993 - DNA, 2379 bp, Homo sapiens
  misc_feature (1673)..(1673): n is a, c, g, or t
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418994 - DNA, 2675 bp, Homo sapiens
  misc_feature (1969)..(1969): n is a, c, g, or t
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccagccctgcctttgtgtccccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418995 - DNA, 2180 bp, Homo sapiens
  misc_feature (1474)..(1474): n is a, c, g, or t
acacaaagcctgtttggtggtctcttcacactgacgtgcatgaaatttggtgctgtgactcggatcgggggacctcccttgggagatcaatcccctgtcctcctgctctttgctccatgagaaagatccacctacgacctcaggtcctcagaccgaccagcccaaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418996 - DNA, 1877 bp, Homo sapiens
  misc_feature (1171)..(1171): n is a, c, g, or t
ctgttaactgttgatatttctttacacagaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418997 - DNA, 4509 bp, Homo sapiens
  misc_feature (1702)..(1702): n is a, c, g, or t
  misc_feature (1925)..(1925): n is a, c, g, or t
  misc_feature (3803)..(3803): n is a, c, g, or t
ctgttaactgttgatatttctttacacagaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagtgaggacctgagtcctgaaccaggcccccagcccgccctctcatgtcctctccaggtcccccaaactctcatttcccagggtagttcctgaagtacctctgaaaagctacacaggcataaagagtaaggaatagtttctcaaaactggaacgggagcctcactgtgccaggttcagaagtaatttataaaacagcaataattaaaacacataatactggtgattcttaataggactgtacaaggacagtagcttcctttttcacttacttttgcctcctttctggagcattgggttttgtgatgattcatagactctttaaggtagggaaagggtttggcaacgttaggcttttgaagctaggaagatagcagagctggagtagatggtgttttgcttccttgggaggggtaaagaggtacagttaattaaatttttttatttctatttttattaaaatttatttttattttctattatttttctaaggagaagataatattagtgcttcctattaggtgccaggcatagcactaaagcacttgcctttctttggtgtagggggagactagtagtaaagtaaaagacctctgaggaagaggttgtaccatatcccaaacggccaaacttaaaaacctttcagtactttagttgattcctatattttcaaacatacggtgaatagtttcacttattttcagcaccattatttgtaccaccttcaaaatctctatttcagacatcctaactgcatattctataggtttttctgttattattcttttaaatcttctcctttggaaaatttcaaacccaaacccaaacagaatagtgtaataatcccctgtacacaccctgcagccttttttttttttttttaagagacagactgttgctctgtcagctatgccggagtgcagtggcatgatcatggctcattgcagtctcagactgctcggctcaagcaatcctcctacctccgcttccctaggactgcaggcatgaaccgccatgcctttaattttttcacagaggcagggtcttgttatgttgcacaggctggtctcaaactcctggcctcaagcgattctcctgcctcagtctcctaaagtgctgggattataggtgtaagccgctgcctgctggcatatcttaaagcaaatcttagacattgcatcaattaacctttaaatactttaaggatttttaaaaatgtaaccatatcattaccacttctgttttcccctgtggtcttaaaaatgtctttttataactggtttgtttaaattgggataaacaaggttctcacattgcatttgctttatactaagttcctctcttgggtgggcacagtggtgcacacctgtaatctcagcactttgggaggccaacacagaaggaccacttgagtccaggagttcgaaaccagcctggacaacattgtgaggctccccctacctatacaaaaaaantttttttttttttttttttttttttttgagacggatcctcactctgtcacccaggctggagtgcagtggcgcgatcttagctcactgcaacctccacctcccgggttcaagcgattctcctgcctccacctcccgagtagctgggactacaggcgcgtgccaccacgcctggctaattttttctgtttttagtagagatgcggtttcactgtgttagccaggntggtctcgatcttctgaccttgtgatctgcccgccttggcctcccaaagtgctgggattaaaataaattgtttttaattagctgggggtggtgttgcacgcctgtagtcccagctactcaagaggctgaggtgggaggatcgcttgaacccaggaggtcaaggctatagtgagccatgatcatactattgcacttcagcatgggcgacagtgtgagaccctgtcacgaaaaaaaaaaaagtttctttttctttaaaattactagactattcttagagcagttttaggtttacagaaaaactgagcacaaagcacagagttcccatatactccctgtctccacacccagaatgtcccttattataaatgtcttgtctttggtgtggtactcttcagtctctcttcatctgtagcagtgcccatgccttttttttttttttttaatgtcatttatttgttgaagaaactgggtcatttgttgtgtagaatgttccacattctgggtttgtccttgtgctagtgtttaacacacccctcctctcctatatttcttgtgtgttggtggttagatttagaaacctgattagattcatgtcccacatttttggcaagaaaaattcccaggtggttctgtgaacttcttcttgcgtcacatcaggcacttggtgtctggtgccccagttgtagtgatgtgaagattgattagccatctgcagcactcctaacaacctctcttgatcgcatcctgggatcactgccctggaaacatcctctcccttttcttagcccctgctttcttcccttgcctgcctggcttctatgctcccaagcccatcttctaggcacccagattgaggctccatggcaagcagcagggacaggggcagcaggtagcctgaccccaggaaagagatgtgggtgaccttgcatgtctccaggttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418998 - DNA, 1686 bp, Homo sapiens
  misc_feature (980)..(980): n is a, c, g, or t
tactctagagatccgtaagaacaggtgaggtctgcacggctggggtcagtctcggcatcttcccgatgccagcttggcggtatgtctcagaacgtaactacacttccgtttgtcgctcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 418999 - DNA, 1367 bp, Homo sapiens
  misc_feature (661)..(661): n is a, c, g, or t
gcggccgcctactactactactgctcgaattcaagcttctaacgatgtacggggaatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 419000 - DNA, 288 bp, Homo sapiens
agatgagggattgagtctgagtaggagtctttttgggggctgtgtggtgagagtgataccccctcactgctgccatctggcccttgtgatagaatgcacgctgtactagcatctcctgggagctgaggcagaccctgtcagttgtatttgatgccttcatcacggggcagggaaagaaaggtaagttaccttggcaactcatctgtacccacccatgccagccctgccttatctatgtggactaggcctaggcctggcccctgctcagccctgcgctctgtttctcag

SEQ ID NO: 419001 - DNA, 2454 bp, Homo sapiens
  misc_feature (1748)..(1748): n is a, c, g, or t
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatggttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 419002 - DNA, 1519 bp, Homo sapiens
  misc_feature (37)..(37): n is a, c, g, or t
  misc_feature (813)..(813): n is a, c, g, or t
agggtcgttatgatggtcgtcgttatgaggtcgatgnccccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 419003 - DNA, 1353 bp, Homo sapiens
  misc_feature (647)..(647): n is a, c, g, or t
ccccggagaactcctgctgctcccgggagaattcctgctgctcccgctcaactggatggaaaccttggtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaacaaaaacaaaanaaaaaaaaaaaaaaaaaaccgggggcagaatcacaatggcgggggtggacggacaaaagcacggtgacagacgaaaacgggccagaggcggccagacaagttgagtacttccgacgcccccacttttctttgtggagcacgagggggaaggaaacagcgggcgggacccccccaaagaggggaggaacgagaataaagatcaggcagacaacacccgggtaagcagctgggattaatagtgatgccgacgggcaaaaggaccagcgaggcacacaaccgcagacaacggcaaactgacgaccgacgaggagcgaaacgacgtcgcgacaatcaatcccacaactgggacagagagacgcgggagacaggacacacacagaaacacacaggaacaccaagcgaagagcacggcgagacgaacaggacagccagcatcacggcaggagtcgggaccagcagacacgaaccgccagaacgtagccatcaggggcaacaaggaggccacagaccaccgcgaaaccgagggtcaaagcgagctacgcgtgccgagagccgcgaagcaacgcggaaccgcacgagaccgaagaacgcagaccaacgcaacacgcagagcgcccacagcgagaccccagtcacaacgatagcaacaagaagaaggagaaggataaaccggaagtacggacgaagaggcacaacatgctcaact

SEQ ID NO: 419004 - DNA, 2447 bp, Homo sapiens
ccccgccttctcgctgcccagccccggggagggaggcggggccgcgaccccggcgcgggtggggcgaatgcgttcccagcgggtagcctggggctggtgcagagttccaagcccacggccccggtcgcggcctcgccgccctcccgcgccccgcgccgggagcgggcctagagcgctcgcctcgcccctccgcgagcagggctctggcgcccgcccctgtccgcaccgctggcagcctgaagagagtcgctggccgtggtcgccgctaggtaggatatatctgcatcttgaaaggaagataaaacaaaagccttctttggaatagatggatttttgtcactttctgtgtgaactaaagtgattcaatgtctcttttggattgcttctgcacttcaagaacacaagttgaatcactcagacctgaaaaacagtctgaaaccagtatccatcaatacttggttgatgagccaaccctttcctggtcacgtccatccactagagccagtgaagtactatgttccaccaacgtttctcactatgagctccaagtagaaataggaagaggatttgacaacttgacttctgtccatcttgcacggcatactcccacgggaacactggtaactataaaaattacaaatctggaaaactgcaatgaagaacgcctgaaagctttacagaaagccgtgattctatcccactttttccggcatcccaatattacaacttattggacagttttcactgttggcagctggctttgggttatttctccatttatggcctatggttcagcaagtcaactcttgaggacctattttcctgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctgtcccatctgcatagtttggttaagcatggacagaggcatagggctgtgtatgatttcccacagttcagcacatcagtgcagccgtggctgagtccagaactactgagacaggatttacatgggtataatgtgaagtcagatatttacagtgttgggattacagcatgtgaattagccagtgggcaggtgcctttccaggacatgcatagaactcagatgctgttacagaaactgaaaggtcctccttatagcccattggatatcagtattttccctcaatcagaatccagaatgaaaaattcccagtcaggtgtagactctgggattggagaaagtgtgcttgtctccagtggaactcacacagtaaatagtgaccgattacacacaccatcctcaaaaactttctctcctgccttctttagcttggtacagctctgtttgcaacaagatcctgagaaaaggccatcagcaagcagtttattgtcccatgttttcttcaaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagaggacagtgcttccaagtacatcttctcccagattctctggcctttttaatgagctattgttaaaccaacaggctagtttatcttacatcagacccttttctggtagagggaaaatgtttgtgctttccctttttcttctgttaatacttatggtaacacctaactgagcctcactcacattaaatgattcacttgaaatatatacagaaattgtaatttgcttttttttaaaaaagggggctaaagtaacactttcctacttatgtaaattatagatcctaaattcacgcaccccgtgggagctcaataaagatttactgaattgaacacaaaaggggggcgttaaattctcgagggcaagtaccgacaggttgaaagggccatggggttaagagcggggaaaaggggaaagaggtatggaccatgggtggacacgaaggcaaaaaagggactggagggtagaaaggaacatatgaagag

SEQ ID NO: 419005 - DNA, 2169 bp, Homo sapiens
ccccgccttctcgctgcccagccccggggagggaggcggggccgcgaccccggcgcgggtggggcgaatgcgttcccagcgggtagcctggggctggtgcagagttccaagcccacggccccggtcgcggcctcgccgccctcccgcgccccgcgccgggagcgggcctagagcgctcgcctcgcccctccgcgagcagggctctggcgcccgcccctgtccgcaccgctggcagcctgaagagagtcgctggccgtggtcgccgctaggtaggatatatctgcatcttgaaaggaagataaaacaaaagccttctttggaatagatggatttttgtcactttctgtgtgaactaaagtgattcaatgtctcttttggattgcttctgcacttcaagaacacaagttgaatcactcagacctgaaaaacagtctgaaaccagtatccatcaatacttggttgatgagccaaccctttcctggtcacgtccatccactagagccagtgaagtactatgttccaccaacgtttctcactatgagctccaagtagaaataggaagaggatttgacaacttgacttctgtccatcttgcacggcatactcccacgggaacactggtaactataaaaattacaaatctggaaaactgcaatgaagaacgcctgaaagctttacagaaagccgtgattctatcccactttttccggcatcccaatattacaacttattggacagttttcactgttggcagctggctttgggttatttctccatttatggcctatggttcagcaagtcaactcttgaggacctattttcctgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctgtcccatctgcatagtttggttaagcatggacagaggcatagggctgtgtatgatttcccacagttcagcacatcagtgcagccgtggctgagtccagaactactgagacaggatttacatgggtataatgtgaagtcagatatttacagtgttgggattacagcatgtgaattagccagtgggcaggtgcctttccaggacatgcatagaactcagatgctgttacagaaactgaaaggtcctccttatagcccattggatatcagtattttccctcaatcagaatccagaatgaaaaattcccagtcaggtgtagactctgggattggagaaagtgtgcttgtctccagtggaactcacacagtaaatagtgaccgattacacacaccatcctcaaaaactttctctcctgccttctttagcttggtacagctctgtttgcaacaagatcctgagaaaaggccatcagcaagcagtttattgtcccatgttttcttcaaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagaggacagtgcttccaagtacatcttctcccagattctctggcctttttaatgagctattgttaaaccaacaggctagtttatcttacatcagacccttttctggtagagggaaaatgtttgtgctttccctttttcttctgttaatacttatggtaacacctaactgagcctcactcacattaaatgattcacttgaaatata

SEQ ID NO: 419006 - DNA, 2293 bp, Homo sapiens
ccccgccttctcgctgcccagccccggggagggaggcggggccgcgaccccggcgcgggtggggcgaatgcgttcccagcgggtagcctggggctggtgcagagttccaagcccacggccccggtcgcggcctcgccgccctcccgcgccccgcgccgggagcgggcctagagcgctcgcctcgcccctccgcgagcagggctctggcgcccgcccctgtccgcaccgctggcagcctgaagagagtcgctggccgtggtcgccgctaggtaggatatatctgcatcttgaaaggaagataaaacaaaagccttctttggaatagatggatttttgtcactttctgtgtgaactaaagtgattcaatgtctcttttggattgcttctgcacttcaagaacacaagttgaatcactcagacctgaaaaacagtctgaaaccagtatccatcaatacttggttgatgagccaaccctttcctggtcacgtccatccactagagccagtgaagtactatgttccaccaacgtttctcactatgagctccaagtagaaataggaagaggatttgacaacttgacttctgtccatcttgcacggcatactcccacgggaacactggtaactataaaaattacaaatctggaaaactgcaatgaagaacgcctgaaagctttacagaaagccgtgattctatcccactttttccggcatcccaatattacaacttattggacagttttcactgttggcagctggctttgggttatttctccatttatggcctatggttcagcaagtcaactcttgaggacctattttcctgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctgtcccatctgcatagtttggttaagcatggacagaggcatagggctgtgtatgatttcccacagttcagcacatcagtgcagccgtggctgagtccagaactactgagacaggatttacatgggtataatgtgaagtcagatatttacagtgttgggattacagcatgtgaattagccagtgggcaggtgcctttccaggacatgcatagaactcagatgctgttacagaaactgaaaggtcctccttatagcccattggatatcagtattttccctcaatcagaatccagaatgaaaaattcccagtcaggtgtagactctgggattggagaaagtgtgcttgtctccagtggaactcacacagtaaatagtgaccgattacacacaccatcctcaaaaactttctctcctgccttctttagcttggtacagctctgtttgcaacaagatcctgagaaaaggccatcagcaagcagtttattgtcccatgttttcttcaaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagaggacagtgcttccaagtacatcttctcccagattctctggcctttttaatgagctattgttaaaccaacaggctagtttatcttacatcagacccttttctggtagagggaaaatgtttgtgctttccctttttcttctgttaatacttatggtaacacctaactgagcctcactcacattaaatgattcacttgaaatatatacagaaattgtaatttgcttttttttaaaaaagggggctaaagtaacactttcctacttatgtaaattatagatcctaaattcacgcaccccgtgggagctcaataaagatttactgaattga

SEQ ID NO: 419007 - DNA, 2397 bp, Homo sapiens
ccccgccttctcgctgcccagccccggggagggaggcggggccgcgaccccggcgcgggtggggcgaatgcgttcccagcgggtagcctggggctggtgcagagttccaagcccacggccccggtcgcggcctcgccgccctcccgcgccccgcgccgggagcgggcctagagcgctcgcctcgcccctccgcgagcagggctctggcgcccgcccctgtccgcaccgctggcagcctgaagagagtcgctggccgtggtcgccgctaggtaggatatatctgcatcttgaaaggaagataaaacaaaagccttctttggaatagatggatttttgtcactttctgtgtgaactaaagtgattcaatgtctcttttggattgcttctgcacttcaagaacacaagttgaatcactcagacctgaaaaacagtctgaaaccagtatccatcaatacttggttgatgagccaaccctttcctggtcacgtccatccactagagccagtgaagtactatgttccaccaacgtttctcactatgagctccaagtagaaataggaagaggatttgacaacttgacttctgtccatcttgcacggcatactcccacgggaacactggtaactataaaaattacaaatctggaaaactgcaatgaagaacgcctgaaagctttacagaaagccgtgattctatcccactttttccggcatcccaatattacaacttattggacagttttcactgttggcagctggctttgggttatttctccatttatggcctatggttcagcaagtcaactcttgaggacctattttcctgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctgtcccatctgcatagtttggttaagcatggacagaggcatagggctgtgtatgatttcccacagttcagcacatcagtgcagccgtggctgagtccagaactactgagacaggatttacatgggtataatgtgaagtcagatatttacagtgttgggattacagcatgtgaattagccagtgggcaggtgcctttccaggacatgcatagaactcagatgctgttacagaaactgaaaggtcctccttatagcccattggatatcagtattttccctcaatcagaatccagaatgaaaaattcccagtcaggtgtagactctgggattggagaaagtgtgcttgtctccagtggaactcacacagtaaatagtgaccgattacacacaccatcctcaaaaactttctctcctgccttctttagcttggtacagctctgtttgcaacaagatcctgagaaaaggccatcagcaagcagtttattgtcccatgttttcttcaaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagaggacagtgcttccaagtacatcttctcccagattctctggcctttttaatgagctattgttaaaccaacaggctagtttatcttacatcagacccttttctggtagagggaaaatgtttgtgctttccctttttcttctgttaatacttatggtaacacctaactgagcctcactcacattaaatgattcacttgaaatatatacagaaattgtaatttgcttttttttaaaaaagggggctaaagtaacactttcctacttatgtaaattatagatcctaaattcacgcaccccgtgggagctcaataaagatttactgaattgacgaaaaaaaaaaaaaagggggcggtaaaattaccgagggcaaaattataggttacagttttggaaaggccaaggggggttaaaaagggggggtaaacggggagg

SEQ ID NO: 419008 - DNA, 2793 bp, Homo sapiens
ccccgccttctcgctgcccagccccggggagggaggcggggccgcgaccccggcgcgggtggggcgaatgcgttcccagcgggtagcctggggctggtgcagagttccaagcccacggccccggtcgcggcctcgccgccctcccgcgccccgcgccgggagcgggcctagagcgctcgcctcgcccctccgcgagcagggctctggcgcccgcccctgtccgcaccgctggcagcctgaagagagtcgctggccgtggtcgccgctaggtaggatatatctgcatcttgaaaggaagataaaacaaaagccttctttggaatagatggatttttgtcactttctgtgtgaactaaagtgattcaatgtctcttttggattgcttctgcacttcaagaacacaagttgaatcactcagacctgaaaaacagtctgaaaccagtatccatcaatacttggttgatgagccaaccctttcctggtcacgtccatccactagagccagtgaagtactatgttccaccaacgtttctcactatgagctccaagtagaaataggaagaggatttgacaacttgacttctgtccatcttgcacggcatactcccacgggaacactggtaactataaaaattacaaatctggaaaactgcaatgaagaacgcctgaaagctttacagaaagccgtgattctatcccactttttccggcatcccaatattacaacttattggacagttttcactgttggcagctggctttgggttatttctccatttatggcctatggttcagcaagtcaactcttgaggacctattttcctgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctgtcccatctgcatagtttggttaagcatggacagaggcatagggctgtgtatgatttcccacagttcagcacatcagtgcagccgtggctgagtccagaactactgagacaggatttacatgggtataatgtgaagtcagatatttacagtgttgggattacagcatgtgaattagccagtgggcaggtgcctttccaggacatgcatagaactcagatgctgttacagaaactgaaaggtcctccttatagcccattggatatcagtattttccctcaatcagaatccagaatgaaaaattcccagtcaggtgtagactctgggattggagaaagtgtgcttgtctccagtggaactcacacagtaaatagtgaccgattacacacaccatcctcaaaaactttctctcctgccttctttagcttggtacagctctgtttgcaacaagatcctgagaaaaggccatcagcaagcagtttattgtcccatgttttcttcaaacaggtgagctgatctatcatccgttgtctcgatgtttttaattactattaaaaagtcactttattttgttggcttgatgagatattttggttaccaaggttcttactaataactttgttacaaaataaagttaaaaacaagaaaacttttggtagttcaattatagactttctaaaatactttcattcttcaaaacagaatgagtaaaaataaaatggactatcatcacattactgatgcttggtgtatattttgattaatttagagacattttctatgttggctagaaatgatgaaagggcaaagtaactctgataagaagtcagtttctttggctcttcttcctgttttcagatgaccagaatcaaaggcagttttaggggaaatacctgaaaacaattttaaacacatttaacataaattctttaaaagttatttattgctaacaaaactgatatattgaaatgatatatcaacagccttattttgagtttctttaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagaggacagtgcttccaagtacatcttctcccagattctctggcctttttaatgagctattgttaaaccaacaggctagtttatcttacatcagacccttttctggtagagggaaaatgtttgtgctttccctttttcttctgttaatacttatggtaacacctaactgagcctcactcacattaaatgattcacttgaaatatatacagaaattgtaatttgcttttttttaaaaaagggggctaaagtaacactttcctacttatgtaaattatagatcctaaattcacgcaccccgtgggagctcaataaagatttactgaattga

SEQ ID NO: 419009 - DNA, 2087 bp, Homo sapiens
ccccgccttctcgctgcccagccccggggagggaggcggggccgcgaccccggcgcgggtggggcgaatgcgttcccagcgggtagcctggggctggtgcagagttccaagcccacggccccggtcgcggcctcgccgccctcccgcgccccgcgccgggagcgggcctagagcgctcgcctcgcccctccgcgagcagggctctggcgcccgcccctgtccgcaccgctggcagcctgaagagagtcgctggccgtggtcgccgctaggtaggatatatctgcatcttgaaaggaagataaaacaaaagccttctttggaatagatggatttttgtcactttctgtgtgaactaaagtgattcaatgtctcttttggattgcttctgcacttcaagaacacaagttgaatcactcagacctgaaaaacagtctgaaaccagtatccatcaatacttggttgatgagccaaccctttcctggtcacgtccatccactagagccagtgaagtactatgttccaccaacgtttctcactatgagctccaagtagaaataggaagaggatttgacaacttgacttctgtccatcttgcacggcatactcccacgggaacactggtaactataaaaattacaaatctggaaaactgcaatgaagaacgcctgaaagctttacagaaagccgtgattctatcccactttttccggcatcccaatattacaacttattggacagttttcactgttggcagctggctttgggttatttctccatttatggcctatggttcagcaagtcaactcttgaggacctattttcctgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctgtcccatctgcatagtttggttaagcatggacagaggcatagggctgtgtatgatttcccacagttcagcacatcagtgcagccgtggctgagtccagaactactgagacaggatttacatgggtataatgtgaagtcagatatttacagtgttgggattacagcatgtgaattagccagtgggcaggtgcctttccaggacatgcatagaactcagcttggtacagctctgtttgcaacaagatcctgagaaaaggccatcagcaagcagtttattgtcccatgttttcttcaaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagaggacagtgcttccaagtacatcttctcccagattctctggcctttttaatgagctattgttaaaccaacaggctagtttatcttacatcagacccttttctggtagagggaaaatgtttgtgctttccctttttcttctgttaatacttatggtaacacctaactgagcctcactcacattaaatgattcacttgaaatatatacagaaattgtaatttgcttttttttaaaaaagggggctaaagtaacactttcctacttatgtaaattatagatcctaaattcacgcaccccgtgggagctcaataaagatttactgaattga

SEQ ID NO: 419010 - DNA, 1730 bp, Homo sapiens
ctcagctgtatcattttctaactgatttttacaataaaaatgagagtaaaaatcagttactctttctagacattaattagcacatttacgttaagactctaagtagtataaaatgtaaattgctgctaccctactaagttactgtcagtaaatactgtgtgcagtaaatgttgagtatggattaattgaaggatacctctacaattatttcctttagtcaaggttgtagctaagaattgggcttctgacatacattctttttaatctttttcgtattgggttttatagcactaaacctaatttctaacatatttttacacctgaaatctacattctaatataaaggtttttttttataactttcttaaaaatgccatcagcaagcagtttattgtcccatgttttcttcaaacaggtgagctgatctatcatccgttgtctcgatgtttttaattactattaaaaagtcactttattttgttggcttgatgagatattttggttaccaaggttcttactaataactttgttacaaaataaagttaaaaacaagaaaacttttggtagttcaattatagactttctaaaatactttcattcttcaaaacagaatgagtaaaaataaaatggactatcatcacattactgatgcttggtgtatattttgattaatttagagacattttctatgttggctagaaatgatgaaagggcaaagtaactctgataagaagtcagtttctttggctcttcttcctgttttcagatgaccagaatcaaaggcagttttaggggaaatacctgaaaacaattttaaacacatttaacataaattctttaaaagttatttattgctaacaaaactgatatattgaaatgatatatcaacagccttattttgagtttctttaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagaggacagtgcttccaagtacatcttctcccagattctctggcctttttaatgagctattgttaaaccaacaggctagtttatcttacatcagacccttttctggtagagggaaaatgtttgtgctttccctttttcttctgttaatacttatggtaacacctaactgagcctcactcacattaaatgattcacttgaaatatatacagaaattgtaatttgcttttttttaaaaaagggggctaaagtaacactttcctacttatgtaaattatagatcctaaattcacgcaccccgtgggagctcaataaagatttactgaattga

SEQ ID NO: 419011 - DNA, 1230 bp, Homo sapiens
ctcagctgtatcattttctaactgatttttacaataaaaatgagagtaaaaatcagttactctttctagacattaattagcacatttacgttaagactctaagtagtataaaatgtaaattgctgctaccctactaagttactgtcagtaaatactgtgtgcagtaaatgttgagtatggattaattgaaggatacctctacaattatttcctttagtcaaggttgtagctaagaattgggcttctgacatacattctttttaatctttttcgtattgggttttatagcactaaacctaatttctaacatatttttacacctgaaatctacattctaatataaaggtttttttttataactttcttaaaaatgccatcagcaagcagtttattgtcccatgttttcttcaaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagaggacagtgcttccaagtacatcttctcccagattctctggcctttttaatgagctattgttaaaccaacaggctagtttatcttacatcagacccttttctggtagagggaaaatgtttgtgctttccctttttcttctgttaatacttatggtaacacctaactgagcctcactcacattaaatgattcacttgaaatatatacagaaattgtaatttgcttttttttaaaaaagggggctaaagtaacactttcctacttatgtaaattatagatcctaaattcacgcaccccgtgggagctcaataaagatttactgaattga

SEQ ID NO: 419012 - DNA, 1953 bp, Homo sapiens
agaacctggatcttccgctgccattcttcagcaaagaactgcttctcacttaaatagttttgtcgacgcaagctaaggcgatgcagtgctgtagccaaatcactatctcctgagggtcctggttggcccatcttctgggagctcctataggaaaatcgcgttcactgattagatcttgaggatcatcagcatgacccagacctctcctttctataatggaagaggatttgacaacttgacttctgtccatcttgcacggcatactcccacgggaacactggtaactataaaaattacaaatctggaaaactgcaatgaagaacgcctgaaagctttacagaaagccgtgattctatcccactttttccggcatcccaatattacaacttattggacagttttcactgttggcagctggctttgggttatttctccatttatggcctatggttcagcaagtcaactcttgaggacctattttcctgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctgtcccatctgcatagtttggttaagcatggacagaggcatagggctgtgtatgatttcccacagttcagcacatcagtgcagccgtggctgagtccagaactactgagacaggatttacatgggtataatgtgaagtcagatatttacagtgttgggattacagcatgtgaattagccagtgggcaggtgcctttccaggacatgcatagaactcagatgctgttacagaaactgaaaggtcctccttatagcccattggatatcagtattttccctcaatcagaatccagaatgaaaaattcccagtcaggtgtagactctgggattggagaaagtgtgcttgtctccagtggaactcacacagtaaatagtgaccgattacacacaccatcctcaaaaactttctctcctgccttctttagcttggtacagctctgtttgcaacaagatcctgagaaaaggccatcagcaagcagtttattgtcccatgttttcttcaaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagaggacagtgcttccaagtacatcttctcccagattctctggcctttttaatgagctattgttaaaccaacaggctagtttatcttacatcagacccttttctggtagagggaaaatgtttgtgctttccctttttcttctgttaatacttatggtaacacctaactgagcctcactcacattaaatgattcacttgaaatatatacagaaattgtaatttgcttttttttaaaaaagggggctaaagtaacactttcctacttatgtaaattatagatcctaaattcacgcaccccgtgggagctcaataaagatttactgaattga

SEQ ID NO: 419013 - DNA, 2184 bp, Homo sapiens
ccccgccttctcgctgcccagccccggggagggaggcggggccgcgaccccggcgcgggtggggcgaatgcgttcccagcgggtagcctggggctggtgcagagttccaagcccacggccccggtcgcggcctcgccgccctcccgcgccccgcgccgggagcgggcctagagcgctcgcctcgcccctccgcgagcagggctctggcgcccgcccctgtccgcaccgctggcagcctgaagagagtcgctggccgtggtcgccgctaggtaggatatatctgcatcttgaaaggaagataaaacaaaagccttctttggaatagatggatttttgtcactttctgtgtgaactaaagtgattcaatgtctcttttggattgcttctgcacttcaagaacacaagttgaatcactcagacctgaaaaacagtctgaaaccagtatccatcaatacttggttgatgagccaaccctttcctggtcacgtccatccactagagccagtgaagtactatgttccaccaacgtttctcactatgagctccaagtagaaataggaagaggatttgacaacttgacttctgtccatcttgcacggcatactcccacgggaacactggtaactataaaaattacaaatctggaaaactgcaatgaagaacgcctgaaagctttacaggttcagcaagtcaactcttgaggacctattttcctgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctgtcccatctgcatagtttggttaagcatggacagaggcatagggctgtgtatgatttcccacagttcagcacatcagtgcagccgtggctgagtccagaactactgagacaggatttacatgggtataatgtgaagtcagatatttacagtgttgggattacagcatgtgaattagccagtgggcaggtgcctttccaggacatgcatagaactcagatgctgttacagaaactgaaaggtcctccttatagcccattggatatcagtattttccctcaatcagaatccagaatgaaaaattcccagtcaggtgtagactctgggattggagaaagtgtgcttgtctccagtggaactcacacagtaaatagtgaccgattacacacaccatcctcaaaaactttctctcctgccttctttagcttggtacagctctgtttgcaacaagatcctgagaaaaggccatcagcaagcagtttattgtcccatgttttcttcaaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagaggacagtgcttccaagtacatcttctcccagattctctggcctttttaatgagctattgttaaaccaacaggctagtttatcttacatcagacccttttctggtagagggaaaatgtttgtgctttccctttttcttctgttaatacttatggtaacacctaactgagcctcactcacattaaatgattcacttgaaatatatacagaaattgtaatttgcttttttttaaaaaagggggctaaagtaacactttcctacttatgtaaattatagatcctaaattcacgcaccccgtgggagctcaataaagatttactgaattga

SEQ ID NO: 419014 - DNA, 1371 bp, Homo sapiens
ttttttttctttaaatctggaaaagttgtgcctgagtgcatgagatagaatagagacaagttttctctttgtttattaactacagtgggtagcagaatcttggcaacccctgaatgatcaggaatctaatcggtaaaaaaatgtaactttggccccttgatctataaatgtgtctgaaagcattacaacaggactcacaaagctactaagtttgactttcgcagacaatatatctgtgactcccgcttgttttttacatttaccttcattccacagccctgagttactgggtgagtccaagacatctcctcaatataaagtagcacactgtgttactatatgttgcaaccgggagccagtacagactttattcacctcacagttgcaagtgttcaatgcagtcacaatgcccctcagcagtgctcatgcgctgcctgtttttaggaagtattcacgtctaagtggtgtgtatatcttataggaacacttagtatttttaaaacctgattaattaaaaaaaattagtttctaggcagtcccaaatatagtattaaaggccaactgcaaagaaggaacactaagtgttttttaaaccttattaacataaaaaacattagtttttaggcagtcctacattaggtattaaaggccaactgcaaagaacactgagcgaggctctgtagatggatgtaataaaaatctataaaacaatgtgtttaaacctaagaattctactgctttccaattccttccctctgctccttttcctaacctcctgcttctccagcccttccctctgtccctttcatccctcaggccctcctctccccttagtccccaccaccctgtcacttctaaattgtggctctagcattgtcccattacctgctacgtgactgttctctccacagtggtcctgctcctgtgagtcagagtgtgtcatttcctcacctaaaacactccagtggctccacctcggtcttgtgaagcttctagaatgtcaggcacgtgagcatatgagggcatacctggttcatcttaggcactaaatttttgttgactgaatgaatgaaatatgaatgtattaaattgcatcacagaaagttataaaatgtaaaacactgaaaaattaagaaatattttattttatgtaactagtgtgcatatcaattcattccgagtctgttgagcctgtgtatgaattttataagattgcataacaaattatcacaaacattgactttaaacaacacccaattattgttgatttatttgtttttagagacagagtctccctctgtcatccagggtgaagtgcagtcacatgatcatggctcactgcagcctcaaactcctgggctcaagggatct

SEQ ID NO: 419015 - DNA, 919 bp, Homo sapiens
tcttccccgcccgggcacgtaacagagctgggagcctggctgccaggggcgtgttatcgcgggggcagcctgggagcgctgctgcgccgcggcaggagaaacagccgaggacaccctggaagagcaggagcacgtgggcctgcgagaatggcgccaacaccagccctgcaaagccacattccaaagccgggccaaggacagccaccgttgccccgcaggcctcaaggatgacggtcaagccagccaaggccgcctccctagccaggaacctcgcaaagcgcaggcgcacctacctgggtggcgcggctgggcggagtcaagagccggaagtcccttgtgccgcagtccttcccgggaaacctggggaccggaactgcccggagttcccgcccccagacagaaccctgggttgctgggcaaccgatgcggcccccgcagctggtctctgtggtgctgggagcgagcccagtatagctcccacctcctgcgctggtaacctcccgtcccgcccgcctcccttgttgtcgcctctcctcgcgtcgcggaatccttgcccttggcactacttacatctctccgggtcccacaacaccttagcgcccacctgcttcaaagccaagctccaccgaaagcgaggcagtcagcccccggacatggcctcagcgctgactgatcgcacctctcgggccccgagcacctacacctacaccagccggccccgagcactgccctgccagcgcagccgttaccgggacagcctgacgcagccgtgagtgaccaagccagcccctgtgtggtccatacttgcaccccatccccaggccggggtctggccccttcgccctggcaaaaaagctgcttatgctgtcttcccttggctgcactctgccgaaataaaagttctgccctaaagaatctc

SEQ ID NO: 419016 - DNA, 2244 bp, Homo sapiens
tcttccccgcccgggcacgtaacagagctgggagcctggctgccaggggcgtgttatcgcgggggcagcctgggagcgctgctgcgccgcggcaggagaaacagccgaggacaccctggaagagcaggagcacgtgggcctgcgagaatggcgccaacaccagccctgcaaagccacattccaaagccgggccaaggacagccaccgttgccccgcaggcctcaaggatgacggtcaagccagccaaggccgcctccctagccaggaacctcgcaaagcgcaggcgcacctacctgggtggcgcggctgggcggagtcaagagccggaagtcccttgtgccgcagtccttcccgggaaacctggggaccggaactgcccggagttcccgcccccagacagaaccctgggttgctgggcaaccgatgcggcccccgcagctggtctctgtggtgctgggagcgagcccagtatagctcccacctcctgcgctggtaacctcccgtcccgcccgcctcccttgttgtcgcctctcctcgcgtcgcggaatccttgcccttggcactacttacatctctccgggtcccacaacaccttagcgcccacctgcttcaaagccaagctccaccgaaagcgaggcagtcagcccccggacatggcctcagcgctgactgatcgcacctctcgggccccgagcacctacacctacaccagccggccccgagcactgccctgccagcgcagccgttaccgggacagcctgacgcagccagatgaagaacctatgcattatggaaacataatgtatgacagaagggtaattcgaggtaacacttatgcactccagacagggccactgctcggacggcctgattctctagagctccagagacaacgggaggctaggaagagggctcttgccagaaaacaagcccaagagcagctcagaccacaaacacctgaacctgtggaaggcagaaagcatgtcgatgtgcaaacagaattataccttgaagaaattgctgatcgcataatagaagttgatatggaatgccaaacagatgcatttttggacagaccaccaacaccactctttattcctgccaaaactggcaaagatgtggccacccaaatactagaaggagagctctttgactttgatcttgaagttaaaccagtgttagaagttttggtggggaagacaattgagcagtctcttctggaagtaatggaagaagaagagctggctaacctgcgggccagtcagcgtgagtatgaagaactacggaatagtgaacgtgctgaagttcaacgacttgaagagcaagagaggcgacaccgagaagaaaaagtatatataattatattttctttcttaggcagtcttttggctagttagcatattatgttcaaaattacatgtgatgatatatcataaaactaaagatctttgggaatatattagaaaaagatctatagtatttttgctcaagtctctcctatagatcatagatctttcatggacggaattacatcttttaaactccagcttacataaatatacctaaattgagtttccaaaagtttctaaatgaagtgaaagttcctaagttacatgtgtgccagttggaagactctcttaaatatcaggagtcctaaagaaagaaagatgtatgttggtttgccataagtcagtggcagaaagatggaaggaaggaaaaagtgaatgtattggagagagactgtgggtaaaaagcaggggatctggatagaattctgattctttttctcggtgaccaggcccttctttatacccttggtgacacaccagacctatttgggttctcgtagaatatttttcagattctagatttttagaatcttcaataaggaaaggtttacaatccagtttttttacatgtgccagtagcctacagttaggaagcactagaaaagatagtctttctggttctggcaataactgtcagcctttgttgtatactgatgaacaaattataaagtcatatcttaatacctgaaacagttaagaaaaaattcccaaggggcctaacttactatgctgtgaaaagtagcataattgttgggaaatcctactcaatacctatcaaatggactttaattctaagatgaatacttagttgtgtaaagagcatagggcttacaataaggattgtgcaaatttatagatataaaaaaactgtggcaaaataaactttgttgaaatg

SEQ ID NO: 419017 - DNA, 2624 bp, Homo sapiens
tcttccccgcccgggcacgtaacagagctgggagcctggctgccaggggcgtgttatcgcgggggcagcctgggagcgctgctgcgccgcggcaggagaaacagccgaggacaccctggaagagcaggagcacgtgggcctgcgagaatggcgccaacaccagccctgcaaagccacattccaaagccgggccaaggacagccaccgttgccccgcaggcctcaaggatgacggtcaagccagccaaggccgcctccctagccaggaacctcgcaaagcgcaggcgcacctacctgggtggcgcggctgggcggagtcaagagccggaagtcccttgtgccgcagtccttcccgggaaacctggggaccggaactgcccggagttcccgcccccagacagaaccctgggttgctgggcaaccgatgcggcccccgcagctggtctctgtggtgctgggagcgagcccagtatagctcccacctcctgcgctggtaacctcccgtcccgcccgcctcccttgttgtcgcctctcctcgcgtcgcggaatccttgcccttggcactacttacatctctccgggtcccacaacaccttagcgcccacctgcttcaaagccaagctccaccgaaagcgaggcagtcagcccccggacatggcctcagcgctgactgatcgcacctctcgggccccgagcacctacacctacaccagccggccccgagcactgccctgccagcgcagccgttaccgggacagcctgacgcagccagatgaagaacctatgcattatggaaacataatgtatgacagaagggtaattcgaggtaacacttatgcactccagacagggccactgctcggacggcctgattctctagagctccagagacaacgggaggctaggaagagggctcttgccagaaaacaagcccaagagcagctcagaccacaaacacctgaacctgtggaaggcagaaagcatgtcgatgtgcaaacagaattataccttgaagaaattgctgatcgcataatagaagttgatatggaatgccaaacagatgcatttttggacagaccaccaacaccactctttattcctgccaaaactggcaaagatgtggccacccaaatactagaaggagagctctttgactttgatcttgaagttaaaccagtgttagaagttttggtggggaagacaattgagcagtctcttctggaagtaatggaagaagaagagctggctaacctgcgggccagtcagcgtgagtatgaagaactacggaatagtgaacgtgctgaagttcaacgacttgaagagcaagagaggcgacaccgagaagaaaaagaacggcgtaagaaacagcagtgggaaataatgcacaagcacaacgagacatcacaaaaaatcgccgcccgagcatttgcacagcgttacctggctgaccttctcccgtctgtttttggcagcctcagggatagtggctacttttatgatcccattgaaagagatattgagataggatttcttccatggctaatgaatgaagttgaaaaaaccatggaatatagcatggtgggaagaacagtgcttgacatgttgatccgtgaggtggttgaaaagaggctgtgtatgtatgagcatggggaagacacacatcagtctccagaacccgaggatgagcctggtggtcctggagcaatgacagagtcactggaggcctctgaattcctggagcagagcatgtcacagacacgggagctgcttttagatggaggctacctacaaagaacaacatatgacagaaggtcatcccaggaaaggaagtttatggaagagagagaactcttagggcaagatgaagaaacagcaatgaggaagtccttaggggaggaagaattgtcataggagggaagcttcaaagtcatgaaaccaatcaacagccaagtcagcaagcaatcaggtaatgatgtgcgagtcccctcaggttatagaaattatgttgtatttagtcagtatgtctttttgtgtaatggactgggccaatcaaatgtgataaaattaatttgagaatgaaacttaaattgaattcatttatttaatagaatattcaaaggctatattgtaattctaatgagaattatatttaattactagctttctattaccattatatgtaaccagcaaatatatttttccttagcccttctaattttgcgggttagttttttttagtaagtatgatatttaatgttcaatatcagtgctgtcagccatatagcttttcttctctataggaaaactatttcacctactgtaagagtgaatgcctagccaggcgtggtggctcacacctgtaatcccagcactttgggaggctgaggctggcagatcccctgaggtcgggagtttgagaccagccagaccaacaaggagaaaccccatctctgctaaaaatacaaaattagccaggcatggtggcgcatgcctgtaatcctagctacttgggaggctgaggcaggagaatcacttgaacctggggcggaggttgcggtgagccaagtttgcaccattgcactccagcctgggcaacaagagcaaaactccgtctcaaaaaaaaaa

SEQ ID NO: 419018 - DNA, 1992 bp, Homo sapiens
taggatcccgtgtgacgtggagtgtcgtggtcgcatcgatgcatggtcgctctgtcgttttcagagtcgtgactctaaacccggccccgagcactgccctgccagcgcagccgttaccgggacagcctgacgcagccagatgaagaacctatgcattatggaaacataatgtatgacagaagggtaattcgaggtaacacttatgcactccagacagggccactgctcggacggcctgattctctagagctccagagacaacgggaggctaggaagagggctcttgccagaaaacaagcccaagagcagctcagaccacaaacacctgaacctgtggaaggcagaaagcatgtcgatgtgcaaacagaattataccttgaagaaattgctgatcgcataatagaagttgatatggaatgccaaacagatgcatttttggacagaccaccaacaccactctttattcctgccaaaactggcaaagatgtggccacccaaatactagaaggagagctctttgactttgatcttgaagttaaaccagtgttagaagttttggtggggaagacaattgagcagtctcttctggaagtaatggaagaagaagagctggctaacctgcgggccagtcagcgtgagtatgaagaactacggaatagtgaacgtgctgaagttcaacgacttgaagagcaagagaggcgacaccgagaagaaaaagaacggcgtaagaaacagcagtgggaaataatgcacaagcacaacgagacatcacaaaaaatcgccgcccgagcatttgcacagcgttacctggctgaccttctcccgtctgtttttggcagcctcagggatagtggctacttttatgatcccattgaaagagatattgagataggatttcttccatggctaatgaatgaagttgaaaaaaccatggaatatagcatggtgggaagaacagtgcttgacatgttgatccgtgaggtggttgaaaagaggctgtgtatgtatgagcatggggaagacacacatcagtctccagaacccgaggatgagcctggtggtcctggagcaatgacagagtcactggaggcctctgaattcctggagcagagcatgtcacagacacgggagctgcttttagatggaggctacctacaaagaacaacatatgacagaaggtcatcccaggaaaggaagtttatggaagagagagaactcttagggcaagatgaagaaacagcaatgaggaagtccttaggggaggaagaattgtcataggagggaagcttcaaagtcatgaaaccaatcaacagccaagtcagcaagcaatcaggtaatgatgtgcgagtcccctcaggttatagaaattatgttgtatttagtcagtatgtctttttgtgtaatggactgggccaatcaaatgtgataaaattaatttgagaatgaaacttaaattgaattcatttatttaatagaatattcaaaggctatattgtaattctaatgagaattatatttaattactagctttctattaccattatatgtaaccagcaaatatatttttccttagcccttctaattttgcgggttagttttttttagtaagtatgatatttaatgttcaatatcagtgctgtcagccatatagcttttcttctctataggaaaactatttcacctactgtaagagtgaatgcctagccaggcgtggtggctcacacctgtaatcccagcactttgggaggctgaggctggcagatcccctgaggtcgggagtttgagaccagccagaccaacaaggagaaaccccatctctgctaaaaatacaaaattagccaggcatggtggcgcatgcctgtaatcctagctacttgggaggctgaggcaggagaatcacttgaacctggggcggaggttgcggtgagccaagtttgcaccattgcactccagcctgggcaacaagagcaaaactccgtctcaaaaaaaaaa

SEQ ID NO: 419019 - DNA, 1934 bp, Homo sapiens
ccagattctaaatatcaggaaagacgctgtgggaaaatagcaggccaaaagttcttagtaaactgcagccagggagactcagactagaatggaggtagaaagaactgatgcagagtgggtttaattctaagcctttttgtggctaagttttgttgttgttaacttattgaatttagagttgtattgcactggtcatgtgaaagccagagcagcaccagtgtcaaaatagtgacagagagttttgaataccatagttagtatatatgtactcagagtatttttattaaagaaggcaaagagcccggcatagatcttatcttcatcttcactcggttgcaaaatcaatagttaagaaatagcatctaagggaacttttaggtgggaaaaaaaatctagagatggctctaaatgactgtttccttctgaacttggaggtggaccatttcatgcactgcaacatctccagtcacagtgcggatctccccgtgaacgatgactggtcccacccggggatcctctatgtcatccctgcagtttatggggttatcattctgataggcctcattggcaacatcactttgatcaagatcttctgtacagtcaagtccatgcgaaacgttccaaacctgttcatttccagtctggctttgggagacctgctcctcctaataacgtgtgctccagtggatgccagcaggtacctggctgacagatggctatttggcaggattggctgcaaactgatcccctttatacagcttacctctgttggggtgtctgtcttcacactcacggcgctctcggcagacagatacaaagccattgtccggccaatggatatccaggcctcccatgccctgatgaagatctgcctcaaagccgcctttatctggatcatctccatgctgctggccattccagaggccgtgttttctgacctccatcccttccatgaggaaagcaccaaccagaccttcattagctgtgccccatacccacactctaatgagcttcaccccaaaatccattctatggcttcctttctggtcttctacgtcatcccactgtcgatcatctctgtttactactacttcattgctaaaaatctgatccagagtgcttacaatcttcccgtggaagggaatatacatgtcaagaagcagattgaatcccggaagcgacttgccaagacagtgctggtgtttgtgggcctgttcgccttctgctggctccccaatcatgtcatctacctgtaccgctcctaccactactctgaggtggacacctccatgctccactttgtcaccagcatctgtgcccgcctcctggccttcaccaactcctgcgtgaacccctttgccctctacctgctgagcaagagtttcaggaaacagttcaacactcagctgctctgttgccagcctggcctgatcatccggtctcacagcactggaaggagtacaacctgcatgacctccctcaagagtaccaacccctccgtggccacctttagcctcatcaatggaaacatctgtcacgagcggtatgtctagattgacccttgattttgccccctgagggacggttttgctttatggctagacaggaacccttgcatccattgttgtgtctgtgccctccaaagagccttcagaatgctcctgagtggtgtaggtgggggtggggaggcccaaatgatggatcaccattatattttgaaagaagccatcaagtcttaagtttttcatttcaacttgtgaacgtttcttctgatgtgaagcaaaccttcccttttcagaaaagggaacaagtagaaaattattttttaagcctcaagccctgttaaatggtcgtggccaattatgtcatagaaactgtatgaacaaccagatttacatagcagagaaatcatacattgaatgcttactttgtga

SEQ ID NO: 419020 - DNA, 2320 bp, Homo sapiens
atccctccctggccggcgccgagccagagcgcagcggcctccaccgcctccccaggcgcgcacacacccgcacacgcgcacgcacgctcaccgtcctctgccaccactctctgctcccgccactcgccgcgcccgcgagccccgcagcaaagcacaggtggcagcggctgcaggggcgcatcgccggcgtgcgccctcctgcagccctgggcgcatcgctctctcggggaagccaccctcggagcccccggagctccccgccaagcgccatccccgcgggcggaggggagcgcgggtcgcgcgccgtggagagccgggacgcggattagcgcccgcaggagcctcctgcgcccgttgaggcgctaaagggcttaccccggaggcgggtggaagggcgggcagaggctcctcttaaataccgctcccggccgcacttcgcgctcaccccggcgtccgctttctccctcgcccacagctgccggatagtgctgaagaggagggggcgttccccagaccatggcatctacggaaggtgccaacaatatgcccaagcaggtggaagtgcgaatgcacgacagtcatcttggctcagaggaacccaagcaccggcacctgggcctgcgcctgtgtgacaagctggggaagaatctgctgctcaccctgacggtgtttggtgtcatcctgggagcagtgtgtggagggcttcttcgcttggcatctcccatccaccctgatgtggttatgttaatagccttcccaggggatatactcatgaggatgctaaaaatgctcattctccctctaatcatctccagcttaatcacagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacagattcaaacagtgacgaagaaagtcctggttgcaccaccgccggacgaggaggccaacgcaaccagcgctgttgtctctctgttgaacgagactgtgactgaggtgccggaggagactaagatggttatcaagaagggcctggagttcaaggatgggatgaacgtcttaggtctgatagggtttttcattgcttttggcatcgctatggggaagatgggagatcaggccaagctgatggtggatttcttcaacattttgaatgagattgtaatgaagttagtgatcatgatcatgtggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccttttttgctggcattttccaagcttggatcactgccctgggcaccgcttccagtgctggaactttgcctgtcacctttcgttgcctggaagaaaatctggggattgataagcgtgtgactagattcgtccttcctgttggagcaaccattaacatggatggtacagccctttatgaagcggtagccgccatctttatagcccaaatgaatggtgttgtcctggatggaggacagattgtgactgtaagcctcacagccaccctggcaagcgtcggcgcggccagtatccccagtgccgggctggtcaccatgctcctcattctgacagccgtgggcctgccaacagaggacatcagcctgctggtggctgtggactggctgctggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaaggtaactctggcagccaatggaaagtcagccgactgcagtgttgaggaagaaccttggaaacgtgagaaataaggatatgagtctcagcaaattcttgaataaactccccagcgtatcctatggtaactgatgatataaacaagctttcttt

SEQ ID NO: 419021 - DNA, 142 bp, Homo sapiens
  misc_feature (5)..(5): n is a, c, g, or t
  misc_feature (134)..(134): n is a, c, g, or t
  misc_feature (137)..(137): n is a, c, g, or t
  misc_feature (140)..(141): n is a, c, g, or t
cagcngccgactccgctggacctgggacccccagacgtgggaggatggggtgggtgtgcctgcactggttgacggtcaggtgggctgattggttctccctgctacagtggtagaattcagcgctgtacctaggnaanaanng

SEQ ID NO: 419022 - DNA, 3079 bp, Homo sapiens
atccctccctggccggcgccgagccagagcgcagcggcctccaccgcctccccaggcgcgcacacacccgcacacgcgcacgcacgctcaccgtcctctgccaccactctctgctcccgccactcgccgcgcccgcgagccccgcagcaaagcacaggtggcagcggctgcaggggcgcatcgccggcgtgcgccctcctgcagccctgggcgcatcgctctctcggggaagccaccctcggagcccccggagctccccgccaagcgccatccccgcgggcggaggggagcgcgggtcgcgcgccgtggagagccgggacgcggattagcgcccgcaggagcctcctgcgcccgttgaggcgctaaagggcttaccccggaggcgggtggaagggcgggcagaggctcctcttaaataccgctcccggccgcacttcgcgctcaccccggcgtccgctttctccctcgcccacagctgccggatagtgctgaagaggagggggcgttccccagaccatggcatctacggaaggtgccaacaatatgcccaagcaggtggaagtgcgaatgcacgacagtcatcttggctcagaggaacccaagcaccggcacctgggcctgcgcctgtgtgacaagctggggaagaatctgctgctcaccctgacggtgtttggtgtcatcctgggagcagtgtgtggagggcttcttcgcttggcatctcccatccaccctgatgtggttatgttaatagccttcccaggggatatactcatgaggatgctaaaaatgctcattctccctctaatcatctccagcttaatcacagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacagattcaaacagtgacgaagaaagtcctggttgcaccaccgccggacgaggaggccaacgcaaccagcgctgttgtctctctgttgaacgagactgtgactgaggtgccggaggagactaagatggttatcaagaagggcctggagttcaaggatgggatgaacgtcttaggtctgatagggtttttcattgcttttggcatcgctatggggaagatgggagatcaggccaagctgatggtggatttcttcaacattttgaatgagattgtaatgaagttagtgatcatgatcatgtggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccttttttgctggcattttccaagcttggatcactgccctgggcaccgcttccagtgctggaactttgcctgtcacctttcgttgcctggaagaaaatctggggattgataagcgtgtgactagattcgtccttcctgttggagcaaccattaacatggatggtacagccctttatgaagcggtagccgccatctttatagcccaaatgaatggtgttgtcctggatggaggacagattgtgactgtaagcctcacagccaccctggcaagcgtcggcgcggccagtatccccagtgccgggctggtcaccatgctcctcattctgacagccgtgggcctgccaacagaggacatcagcctgctggtggctgtggactggctgctggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaaggtaactctggcagccaatggaaagtcagccgactgcagtgttgaggaagaaccttggaaacgtgagaaataaggatatgagtctcagcaaattcttgaataaactccccagcgtatcctatggtaactgatgatataaacaagctttctttaaaaaggaaaaaaatgcgtatatttctatgtttacttaatctgttagccgaggcttagaggagctcttgtgagtcagtgatgacaggcacggtgctgtgtctttgccaaataatgctttataaccgtctaattttctcacttgtattattatttgaatggatgctgctggaggaatcagttggaattgaagacacgttcttgccagcttcccttttctcccaagatgcagaaatgtggatgctcttttcccaggggacatgagtaaagcagtgtggtacactccagggacttgggaaaatgagcaaacacacagcgtgttattccttaaagtgttctccatgtctcgccttgttatgcacaagagattctattaaaagcctctagaagtaactccccttaaaatgtctagtaaagcttgcacatggattgattaaaagcaaatacctgtcttagggaattctgacaatttatcttccatatgctctttaagtaaaatgtttcaaagacagttttaaagggagccatgctcttaaaggcagttgattaaagaacctgttacatctctgccttaccctgtgtaatctgtgagaacaatggttgaaatttcaaagtatgtttcattattctttctaaatttgataattgattaggaagtattttatatataaccactgtagatattgacaaaagtaagagagcacagtcaacataaagtttaaccagagttaaatattcaaatttatttatgttcggtttgc

SEQ ID NO: 419023 - DNA, 1969 bp, Homo sapiens
  misc_feature (5)..(5): n is a, c, g, or t
cagcngccgactccgctggacctgggacccccagacgtgggaggatggggtgggtgtgcctgcggtgacctagtgtcttccagtagggcaatctctggacatctttatctccccagtacctctccagatcctgaagcctggggccagggaggagaggttagatgtcagcagtggaaggacagtgccaacaatatgcccaagcaggtggaagtgcgaatgcacgacagtcatcttggctcagaggaacccaagcaccggcacctgggcctgcgcctgtgtgacaagctggggaagaatctgctgctcaccctgacggtgtttggtgtcatcctgggagcagtgtgtggagggcttcttcgcttggcatctcccatccaccctgatgtggttatgttaatagccttcccaggggatatactcatgaggatgctaaaaatgctcattctccctctaatcatctccagcttaatcacagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacagattcaaacagtgacgaagaaagtcctggttgcaccaccgccggacgaggaggccaacgcaaccagcgctgttgtctctctgttgaacgagactgtgactgaggtgccggaggagactaagatggttatcaagaagggcctggagttcaaggatgggatgaacgtcttaggtctgatagggtttttcattgcttttggcatcgctatggggaagatgggagatcaggccaagctgatggtggatttcttcaacattttgaatgagattgtaatgaagttagtgatcatgatcatgtggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccttttttgctggcattttccaagcttggatcactgccctgggcaccgcttccagtgctggaactttgcctgtcacctttcgttgcctggaagaaaatctggggattgataagcgtgtgactagattcgtccttcctgttggagcaaccattaacatggatggtacagccctttatgaagcggtagccgccatctttatagcccaaatgaatggtgttgtcctggatggaggacagattgtgactgtaagcctcacagccaccctggcaagcgtcggcgcggccagtatccccagtgccgggctggtcaccatgctcctcattctgacagccgtgggcctgccaacagaggacatcagcctgctggtggctgtggactggctgctggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaaggtaactctggcagccaatggaaagtcagccgactgcagtgttgaggaagaaccttggaaacgtgagaaataaggatatgagtctcagcaaattcttgaataaactccccagcgtatcctatggtaactgatgatataaacaagctttcttt

SEQ ID NO: 419024 - DNA, 2214 bp, Homo sapiens
atccctccctggccggcgccgagccagagcgcagcggcctccaccgcctccccaggcgcgcacacacccgcacacgcgcacgcacgctcaccgtcctctgccaccactctctgctcccgccactcgccgcgcccgcgagccccgcagcaaagcacaggtggcagcggctgcaggggcgcatcgccggcgtgcgccctcctgcagccctgggcgcatcgctctctcggggaagccaccctcggagcccccggagctccccgccaagcgccatccccgcgggcggaggggagcgcgggtcgcgcgccgtggagagccgggacgcggattagcgcccgcaggagcctcctgcgcccgttgaggcgctaaagggcttaccccggaggcgggtggaagggcgggcagaggctcctcttaaataccgctcccggccgcacttcgcgctcaccccggcgtccgctttctccctcgcccacagctgccggatagtgctgaagaggagggggcgttccccagaccatggcatctacggaaggtgccaacaatatgcccaagcaggtggaagtgcgaatgcacgacagtcatcttggctcagaggaacccaagcaccggcacctgggcctgcgcctgtgtgacaagctggggaagaatctgctgctcaccctgacggtgtttggtgtcatcctgggagcagtgtgtggagggcttcttcgcttggcatctcccatccaccctgatgtggttatgttaatagccttcccaggggatatactcatgaggatgctaaaaatgctcattctccctctaatcatctccagcttaatcacagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacagattcaaacagtgacgaagaaagtcctggttgcaccaccgccggacgaggaggccaacgcaaccagcgctgttgtctctctgttgaacgagactgtgactgaggtgccggaggagactaagatggttatcaagaagggcctggagttcaaggatgggatgaacgtcttaggtctgatagggtttttcattgcttttggcatcgctatggggaagatgggagatcaggccaagctgatggtggatttcttcaacattttgaatgagattgtaatgaagttagtgatcatgatcatgtggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccttttttgctggcattttccaagcttggatcactgccctgggcaccgcttccagtgctggaactttgcctgtcacctttcgttgcctggaagaaaatctggggattgataagcgtgtgactagattcgtccttcctgttggagcaaccattaacatggatggtacagccctttatgaagcggtagccgccatctttatagcccaaatgaatggtgttgtcctggatggaggacagattgtgactgtaagcctcacagccaccctggcaagcgtcggcgcggccagtatccccagtgccgggctggtcaccatgctcctcattctgacagccgtgggcctgccaacagaggacatcagcctgctggtggctgtggactggctgctggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaaggtacatttcccattcatggatatcgagacttgtatatagtagtgc

SEQ ID NO: 419025 - DNA, 1848 bp, Homo sapiens
tgtgattctttcggactggtagattatcatggagtatctttttgttgtctggtagtagtaggtaatagtttacttaggatttcccagtatttacttctgtgcttttatgtggcttcctgatgtgttaattacccctcacctatagcaaaagctgtacctccggccgggtgcagtggctcacgcctgtaatcccagcactttgggaggccgaggtgggcagatcacgaggtcaggagatcgagaccatcctggctaacacagtgaaaccccgtctctactaaaaatacaaaaaattagcccggcatggtggcgggcgcctgtagtcccaactactcaggaggctgaggcaggagaatggtgtgaacccgggaggtggagcttgcagtgagccgagatcgcgccactgcactccagcctgggcgacagagcgagactccgtctcaaaaaaaaaaaaaaaaaagctctacctcctgcttgactggcaacacaggatgtcttgtgcagcaagtataaaggacaaaaacacaaacatataacacttcccagtggggcttccatcagtccccaaccggacagtgccccctagaccatagaccccacagagcataacactgaagcacaggatcccagatacggctctcccaaactttgttttgtttagtttaacatcgccaactcactgttttgtcttagaaacatgaaatcaaacagaatgagaatataattttttttggagttggagcaaatctagataagggtcacaattgccccaagacttgcccaatttgagctcatgctacacaattaaatatattccttaaatattgtgtgcttgcaacttttgattttgtaaatgggttcccacaggacaaaaatgagtcttaaacataaaattaaaccatatgaatgttagttttttagttaatttcagctgggtggtagtctatagtcccagctactcgagaggctgaggcagaaggatcgcttgagcccaggagttcagggctgcagtgagctgtgatcacaccactgcactccagcctgggggaagagcaagaccctacaaacaaaaaagagttaattccattatatttatttttacatacccagagtttgactaaaatataccagacaatctcctgtccccaaatccatgtccaagcaaggggagccacgttttctaagctcacagtttaaaggttaaagagacacactgaggaaaactcagggaaagaagctgatttgcatggacactaggcctgtcgttgattccctcatttcaaaagttgcatgtgccatgggaggcggagtctctgaggacatcctggctgtgcctcggtggctctggactccagctctacgcagagcgccttaacactgtactggaagaaatgggaaatcgcattgaggacttacagaagaatgtcaatgacttaatggtgcaagctggcattgaaaattctattaaagaacaaatgctgaagacctaactgcagcatgtctgtatttggagatggggcctctacagaagtcattaaggttacatcggtcctgagggtggggccctcatccaacaggattcgtctttctgagaagagacgcaaggggctcgcctgctctccccccgtgcctgcaccagagaaggaggccatcggcaagccaaggagagccctccccagaaatcacacggaccagcaccttgatctgggacttccagaaaacagaactgtgaaaagacaagtttctgttgtttaaaccacccaatctgaagtattttgttatggcagtcctgggcagactaatacaatatgcaacacatttacaataaatatacaataaacttacaaa

SEQ ID NO: 419026 - DNA, 775 bp, Homo sapiens
aggaaagagacataaaccaattgtttttcagaccacaaggctttgtgccaagtgccatgtgtgtcaagtcaggaatccctcctcctggagccaagaggaagtcgggaatcgcggagcttagctgtcgccacctcgcgccgggtccgcgcggcccacgggaccccccactgacgcccccggccagcggtccacatggacgtgcggggccctgaagcccccggcgggcgcgcgctgcgggacgcggcagaaaatctatttcaggaacttcaggaacattttcaagctctgacggcaacattaaacctcagaatggaagaaatgggaaatcgcattgaggacttacagaagaatgtcaatgacttaatggtgcaagctggcattgaaaattctattaaagaacaaatgctgaagacctaactgcagcatgtctgtatttggagatggggcctctacagaagtcattaaggttacatcggtcctgagggtggggccctcatccaacaggattcgtctttctgagaagagacgcaaggggctcgcctgctctccccccgtgcctgcaccagagaaggaggccatcggcaagccaaggagagccctccccagaaatcacacggaccagcaccttgatctgggacttccagaaaacagaactgtgaaaagacaagtttctgttgtttaaaccacccaatctgaagtattttgttatggcagtcctgggcagactaatacaatatgcaacacatttacaataaatatacaataaacttacaaa

SEQ ID NO: 419027 - DNA, 667 bp, Homo sapiens
ctctgttgctggctgtaacctggggaaatctaagctttagttttcttctctgccaaatatctacctggtaagtggttgtaaggatttaagaaaattgcttgcaaagcacttaagtcagggcaaggtagacagcaggtacataatgagataaacttgaaatacagagtccaaatcattatgatttcaactgtactgcagccacaaagcaccagtgagaacgttattaaaatcaggggtgaacatacttaatacacctgataggagttacggcctgaacgtttatgtctccctaaatagctgaagacctaactgcagcatgtctgtatttggagatggggcctctacagaagtcattaaggttacatcggtcctgagggtggggccctcatccaacaggattcgtctttctgagaagagacgcaaggggctcgcctgctctccccccgtgcctgcaccagagaaggaggccatcggcaagccaaggagagccctccccagaaatcacacggaccagcaccttgatctgggacttccagaaaacagaactgtgaaaagacaagtttctgttgtttaaaccacccaatctgaagtattttgttatggcagtcctgggcagactaatacaatatgcaacacatttacaataaatatacaataaacttacaaa

SEQ ID NO: 419028 - DNA, 527 bp, Homo sapiens
tatttcaggaacttcaggaacattttcaagctctgacggcaacattaaacctcagaaatatccttttctacctttaacaaatgctgtgattctttcggactggtagattatcatggagtatctttttgttgtctggtagtagtaggtaatagtttacttaggatttcccagtatttacttctgtgcttttatgtggcttcctgatgtgttaattacccctcacctatagcaaaagctgtacctccggccgggtgcagtggctcacgcctgtaatcccagcactttgggaggccgaggtgggcagatcacgaggtcaggagatcgagaccatcctggctaacacagtgaaaccccgtctctactaaaaatacaaaaaattagcccggcatggtggcgggcgcctgtagtcccaactactcaggaggctgaggcaggagaatggtgtgaacccgggaggtggagcttgcagtgagccgagatcgcgccactgcactccagcctgggcgacagagcgagactccgtctca

SEQ ID NO: 419029 - DNA, 475 bp, Homo sapiens
ccaacagtaaatatttattcaattgtcttacggtttattttttcaggcagaaaatctatttcaggaacttcaggaacattttcaagctctgacggcaacattaaacctcagaaatatccttttctacctttaacaaatgctgtgattctttcggactggtagattatcatggagtatctttttgttgtctggtagtagtaggtaatagtttacttaggatttcccagtatttacttctgtgcttttatgtggcttcctgatgtgttaattacccctcacctatagcaaaagctgtacctccggccgggtgcagtggctcacgcctgtaatcccagcactttgggaggccgaggtgggcagatcacgaggtcaggagatcgagaccatcctggctaacacagtgaaaccccgtctctactaaaaatacaaaaaattagcccggcatggtggcgggcgcctgtagtcccaactactc

SEQ ID NO: 419030 - DNA, 722 bp, Homo sapiens
aggaaagagacataaaccaattgtttttcagaccacaaggctttgtgccaagtgccatgtgtgtcaagtcaggaatccctcctcctggagccaagaggaagtcgggaatcgcggagcttagctgtcgccacctcgcgccgggtccgcgcggcccacgggaccccccactgacgcccccggccagcggtccacatggacgtgcggggccctgaagcccccggcgggcgcgcgctgcgggacgcggcagaaaatctatttcaggaacttcaggaacattttcaagctctgacggcaacattaaacctcagaatggaagaaatgggaaatcgcattgaggacttacagaagaatgtcaatgacttaatggtgcaagctggcattgtggagatggggcctctacagaagtcattaaggttacatcggtcctgagggtggggccctcatccaacaggattcgtctttctgagaagagacgcaaggggctcgcctgctctccccccgtgcctgcaccagagaaggaggccatcggcaagccaaggagagccctccccagaaatcacacggaccagcaccttgatctgggacttccagaaaacagaactgtgaaaagacaagtttctgttgtttaaaccacccaatctgaagtattttgttatggcagtcctgggcagactaatacaatatgcaacacatttacaataaatatacaataaacttacaaa

SEQ ID NO: 419031 - DNA, 2275 bp, Homo sapiens
gctcctagggaggagctggtaccatgggtgtcaggcaacagttggccttgctgctgctgctgctgctcctgctctggggcctggggcagccagtgtggccagtcgctgtggccttgaccctgcgctggctcctgggggatcccacatgttgcgtgctacttgggctggccatgttagcacggccctggctcggcccctgggtgccccatgggctgagcctggcagctgcggccctggcactaaccctcctgccagcacggctgcccccaggactacgctggctgccggctgatgtgatcttcttggccaagatcctccacctgggcctgaagatcaggggatgcttgagccggcagccgcctgacacctttgtagatgccttcgagcggcgagcacgagcgcagcctggcagggcactcttggtgtggacggggcctggggccggctcagtcacctttggtgagctggatgcccgggcctgccaggcggcatgggccctgaaggctgagctgggtgaccctgcgagcctgtgtgccggggagcctactgccctccttgtgctggcttcccaggccgttccagccctgtgtatgtggctggggctggccaagctgggctgcccaacagcctggatcaacccgcatggccgggggatgcccctggcgcactctgtgctgagctctggggcccgggtgctggtggtggacccagacctccgggagagcctggaggagatccttcccaagctgcaggctgagaacatccgctgcttctacctcagccatacctcccctacaccaggggtgggggctctgggggctgccctggatgcagcgccctcccacccagtgcctgctgacctgcgtgctgggatcacatggagaagccctgccctcttcatctatacctcggggaccactggcctcccgaagccagccatcctcacgcatgagcgggtactgcagatgagcaagatgctgtccttatctggggccacagctgatgatgtggtttacacggtcctgcctctgtaccacgtgatgggacttgtcgttgggatcctcggctgcttagatctcggagccacctgtgttctggcccccaagttctctacttcctgcttctgggatgactgtcggcagcatggcgtgacagtgatcctgtatgtgggcgagctcctgcggtacttgtgtaacattccccagcaaccagaggaccggacacatacagtccgcctggcaatgggcaatggactacgggctgatgtgtgggagaccttccagcagcgcttcggtcctattcggatctgggaagtctacggctccacagaaggcaacatgggcttagtcaactatgtggggcgctgcggggccctgggcaagatgagctgcctcctccgaatgctgtccccctttgagctggtgcagttcgacatggaggcggcggagcctgtgagggacaatcagggcttctgcatccctgtagggctaggggagccggggctgctgctgaccaaggtggtaagccagcaacccttcgtgggctaccgcggcccccgagagctgtcggaacggaagctggtgcgcaacgtgcggcaatcgggcgacgtttactacaacaccggggacgtactggccatggaccgcgaaggcttcctctacttccgcgaccgcctcggggacaccttccgatggaagggcgagaacgtgtccacgcacgaggtggagggcgtgttgtcgcaggtggacttcttgcaacaggttaacgtgtatggcgtgtgcgtgccaggttgtgagggtaaggtgggcatggctgctgtgcagctagcccccggccagactttcgacggggagaagttgtaccagcacgttcgcgcttggctccctgcctacgctaccccccatttcatccgcatccaggacgccatggaggtcaccagcacgttcaaactgatgaagacccggttggtgcgtgagggcttcaatgtggggatcgtggttgaccctctgtttgtactggacaaccgggcccagtccttccggcccctgacggcagaaatgtaccaggctgtgtgtgagggaacctggaggctctgatcacctggccaacccactggggtagggatcaaagccagccacccccaccccaacacactcggtgtccctttcatcctgggcctgtgtgaatcccagcctggccataccctcaacctcagtgggctggaaatgacagtgggccctgtagcagtggcagaataaactcagatgtgttcaca

SEQ ID NO: 419032 - DNA, 2002 bp, Homo sapiens
  misc_feature (17)..(17): n is a, c, g, or t
  misc_feature (980)..(980): n is a, c, g, or t
  misc_feature (1805)..(1805): n is a, c, g, or t
cttcccgggggcgtggncacaagcgccggctccctccctgcagatggaagggcgagaacgtgtccacgcacgaggtggagggcgtgttgtcgcaggtggacttcttgcaacaggttaacgtgtatggcgtgtgcgtgccaggttgtgagggtaaggtgggcatggctgctgtgcagctagcccccggccagactttcgacggggagaagttgtaccagcacgttcgcgcttggctccctgcctacgctaccccccatttcatccgcatccaggacgccatggaggtcaccagcacgttcaaactgatgaagacccggttggtgcgtgagggcttcaatgtggggatcgtggttgaccctctgtttgtactggacaaccgggcccagtccttccggcccctgacggcagaaatgtaccaggctgtgtgtgagggaacctggaggctctgatcacctggccaacccactgggacagggtctcatcctgttgcccaggctggagtgcaatggtgttatcagagctcactgcagccttaacctcctgggctcaagtgattctcccacctcagtctccctgggactacagggagcaggagaaacggaagccaactgtgctttcctgggtcttctgctgctctccacactgagacctcaggcccagcctctgcacagacgagtgggaaggcacagtttttgaacacccacctgagagtcttctgctggtgccccagaggctgtatccaggccccgagaacaccgaggccccgagggactgtgctgtctggctgctcatggaacctccggccggtggcccttgcggtggatgaccagctgcgacttccagtcgaaggcgcggccacagtcactgcagaagtgacgccgctggcctgtgtggctcttgcggtggatgaccagctgcgacttccagctgaagctgcacccgcactcctcacacgggtaactccgggggcctgtgagtgngcgtcgggggtggtgcggaaaggccacctccccttgtggtggcttctctgtgctttccccggtggctagccccggggactgcacacctggcccactcgtgtgtgtccggtggtggatgacgaacactgacttccagtcgaagccgcggccacactgctcgcacgtgtagggcttcctgggggtggcagccggctccagtctcgtctctgcaggtgtgggctgagtgggcactggcggtgtccctgggcgcacagtgggggcaggagtggcagccccagacaagccctcccaggctgccggccctgggccctggggcggctgggcctctgggcagccaggtggaccctcactctcatttcctgggggcaggggcaaaccaggtgagtcccggcactcagcaacccctccctcaggcttgtggccgtggcacaagctcccgtccccccatgagtgggtggctcaggtcccaccgatacaggaggggtgattcaggctggatggtgtggggcactcacccgagcgcaggcttctgcagacgcctgtccccgtgagcagcatccccagctctgactgggcctgtgcctctggctggtggggcggtaaccctgcccgggtggggggcacagttaggcatggggtttgcatgaaggaggggtggggtcggttctggtaggtgacagggtgttcctctggaaggtgggagagctgggtagggctggtagcacagaggccctgcccagctaggcctgctgcagggtgggtgcaggccccagggagaggggcggggtggggctggctggtcctcacccagggagaccactgtgncgtacttctccagcatcgcatcccagtacagttccttctgtgaccggtccagcagcccccactcctcctgcggatgtggcccatcactgtaggcgtctttccaccccttccctgccctgtctggttcacattcttacctattacccggaagagtcagcaggttacctacgcctcatctgcccctcctgctgagaatg

SEQ ID NO: 419033 - DNA, 609 bp, Homo sapiens
cgctctaaaattagtgatcccccccgggttccaggaattcgggcccgagcacgaggtggagggcgtgttgtcgcaggtggacttcttgcaacaggttaacgtgtatggcgtgtgcgtgccaggttgtgagggtaaggtgggcatggctgctgtgcagctagcccccggccagactttcgacggggagaagttgtaccagcacgttcgcgcttggctccctgcctacgctaccccccatttcatccgcatccaggacgccatggaggtcaccagcacgttcaaactgatgaagacccggttggtgcgtgagggcttcaatgtggggatcgtggttgaccctctgtttgtactggacaaccgggcccagtccttccggcccctgacggcagaaatgtaccaggctgtgtgtgagggaacctggaggctctgatcacctggccaacccactggggtagggatcaaagccagccacccccaccccaacacactcggtgtccctttcatcctgggcctgtgtgaatcccagcctggccataccctcaacctcagtgggctggaaatgacagtgggccctgtagcagtggcagaataaactcagatgtgttcaca

SEQ ID NO: 419034 - DNA, 1088 bp, Homo sapiens
  misc_feature (1)..(1): n is a, c, g, or t
  misc_feature (6)..(6): n is a, c, g, or t
  misc_feature (9)..(9): n is a, c, g, or t
  misc_feature (31)..(31): n is a, c, g, or t
  misc_feature (36)..(36): n is a, c, g, or t
  misc_feature (891)..(891): n is a, c, g, or t
nttggntanttcagcattttcactttgaaangtagnactggagcttgctgatggaggccctctttgtgaaattgatccatattcctattaataacatcattgtggtggcttctctgtgctttccccggtggctagccccggggactgcacacctggcccactcgtgtgtgtccggtggtggatgacgaacactgacttccagtcgaagccgcggccacactgctcgcacgtgtagggcttcctgggggtggcagccggctccagtctcgtctctgcaggtgtgggctgagtgggcactggcggtgtccctgggcgcacagtgggggcaggagtggcagccccagacaagccctcccaggctgccggccctgggccctggggcggctgggcctctgggcagccaggtggaccctcactctcatttcctgggggcaggggcaaaccaggtgagtcccggcactcagcaacccctccctcaggcttgtggccgtggcacaagctcccgtccccccatgagtgggtggctcaggtcccaccgatacaggaggggtgattcaggctggatggtgtggggcactcacccgagcgcaggcttctgcagacgcctgtccccgtgagcagcatccccagctctgactgggcctgtgcctctggctggtggggcggtaaccctgcccgggtggggggcacagttaggcatggggtttgcatgaaggaggggtggggtcggttctggtaggtgacagggtgttcctctggaaggtgggagagctgggtagggctggtagcacagaggccctgcccagctaggcctgctgcagggtgggtgcaggccccagggagaggggcggggtggggctggctggtcctcacccagggagaccactgtgncgtacttctccagcatcgcatcccagtacagttccttctgtgaccggtccagcagcccccactcctcctgcggatgtggcccatcactgtaggcgtctttccaccccttccctgccctgtctggttcacattcttacctattacccggaagagtcagcaggttacctacgcctcatctgcccctcctgctgagaatg

SEQ ID NO: 419035 - DNA, 2550 bp, Homo sapiens
aggtaaaggtctcaggtaaagattcaggtactgaactcaagtccctcagataatacacctcatgcaagaaccccagataatgagtttcagacaaggcttccaataatggtttctttgatagctgtgctaccttgagcctcagtgtcctcatttggaaaacagggataatagcccctacccctatcatgagaatttccattaaaaattaattaaaattaaatttccattaaattaaagttctaggtaactactcttaggtgagaccccagatgaggcctccagtcacctctggtaacgtcccccaggcaaagctctgaggtcgcccctgcaggtaaccctctatttaagactccagtaactactctcatgtaagtaacccaggtagatcccttaggtagaggtcccccatcaccttccaggtaactcccaaggtaaggacccaggataacaccccctctaggtaaaggttccaaggcatgccccaagagcacctcctcctcacccttctggggacattcctgtagcaaccagaggaccggacacatacagtccgcctggcaatgggcaatggactacgggctgatgtgtgggagaccttccagcagcgcttcggtcctattcggatctgggaagtctacggctccacagaaggcaacatgggcttagtcaactatgtggggcgctgcggggccctgggcaagatgagctgcctcctccgaatgctgtccccctttgagctggtgcagttcgacatggaggcggcggagcctgtgagggacaatcagggcttctgcatccctgtagggctaggtatgggggttgaggagcctttcctgggtggcaggggtggcgaccctcagtcttctgcttggctggaacgagctgctcaaaagcttgacgttggtgctcactagaggggtctgcagccttcatctggaccctgagccagtggcctgccttaccaccatctggggcctccgcctcagcttctcggctctgtccagctcccctgccttgatctcttgctctgatttactgggtctctgggtgtccatctgatttgttctcttgagctttctgtggaagacggcattccagccattggtcccttgtcctgtaccttctgttagtgtcttctcccagggccttgcaaggtcctggtcatatctattctcactgccatttgtctgtccgtcttccatcccttgttatccttttcctgtttctcatgggctccccataccgccttctctatacttctctctcattttctgtgtcgcttgtcgcagtctctcaaggtctctgaatgtctctctcatctctggatctccctgtctgtgtctttgggtctgtccttggcagggtgctgggtgatgaagagtccaccgttgttgaaaacctccagcagggggcttggctggtgggctccaggggttcttgttcctgctcctaccccaggggagccggggctgctgctgaccaaggtggtaagccagcaacccttcgtgggctaccgcggcccccgagagctgtcggaacggaagctggtgcgcaacgtgcggcaatcgggcgacgtttactacaacaccggggacgtactggccatggaccgcgaaggcttcctctacttccgcgaccgcctcggggacaccttccgatggaagggcgagaacgtgtccacgcacgaggtggagggcgtgttgtcgcaggtggacttcttgcaacaggttaacgtgtatggcgtgtgcgtgccaggttgtgagggtaaggtgggcatggctgctgtgcagctagcccccggccagactttcgacggggagaagttgtaccagcacgttcgcgcttggctccctgcctacgctaccccccatttcatccgcatccaggacgccatggaggtcaccagcacgttcaaactgatgaagacccggttggtgcgtgagggcttcaatgtggggatcgtggttgaccctctgtttgtactggacaaccgggcccagtccttccggcccctgacggcagaaatgtaccaggctgtgtgtgagggaacctggaggctctgatcacctggccaacccactggggtagggatcaaagccagccacccccaccccaacacactcggtgtccctttcatcctgggcctgtgtgaatcccagcctggccataccctcaacctcagtgggctggaaatgacagtgggccctgtagcagtggcagaataaactcagatgtgttcacaaaaaacacaaaacataaacagaacaaacccttgctcgcgccgcctgggacccccgcgaaaacagtttcagaaccgactgggggtgggagccgccggcacccatggggtccatgcaaaccgtgggcgcagaggatggccccacgaaaaacctcggcgcataacacacgcgcactgggatattgctcccaatataaacaagccccggggagacaacggagcgctgctgaaaacactccacacaggagacaccagaaggcacaaagggagttcctacaacgaggagccaaagagcgacccgaatataacta

SEQ ID NO: 419036 - DNA, 2238 bp, Homo sapiens
  misc_feature (2238)..(2238): n is a, c, g, or t
aggtaaaggtctcaggtaaagattcaggtactgaactcaagtccctcagataatacacctcatgcaagaaccccagataatgagtttcagacaaggcttccaataatggtttctttgatagctgtgctaccttgagcctcagtgtcctcatttggaaaacagggataatagcccctacccctatcatgagaatttccattaaaaattaattaaaattaaatttccattaaattaaagttctaggtaactactcttaggtgagaccccagatgaggcctccagtcacctctggtaacgtcccccaggcaaagctctgaggtcgcccctgcaggtaaccctctatttaagactccagtaactactctcatgtaagtaacccaggtagatcccttaggtagaggtcccccatcaccttccaggtaactcccaaggtaaggacccaggataacaccccctctaggtaaaggttccaaggcatgccccaagagcacctcctcctcacccttctggggacattcctgtagcaaccagaggaccggacacatacagtccgcctggcaatgggcaatggactacgggctgatgtgtgggagaccttccagcagcgcttcggtcctattcggatctgggaagtctacggctccacagaaggcaacatgggcttagtcaactatgtggggcgctgcggggccctgggcaagatgagctgcctcctccgaatgctgtccccctttgagctggtgcagttcgacatggaggcggcggagcctgtgagggacaatcagggcttctgcatccctgtagggctaggtatgggggttgaggagcctttcctgggtggcaggggtggcgaccctcagtcttctgcttggctggaacgagctgctcaaaagcttgacgttggtgctcactagaggggtctgcagccttcatctggaccctgagccagtggcctgccttaccaccatctggggcctccgcctcagcttctcggctctgtccagctcccctgccttgatctcttgctctgatttactgggtctctgggtgtccatctgatttgttctcttgagctttctgtggaagacggcattccagccattggtcccttgtcctgtaccttctgttagtgtcttctcccagggccttgcaaggtcctggtcatatctattctcactgccatttgtctgtccgtcttccatcccttgttatccttttcctgtttctcatgggctccccataccgccttctctatacttctctctcattttctgtgtcgcttgtcgcagtctctcaaggtctctgaatgtctctctcatctctggatctccctgtctgtgtctttgggtctgtccttggcagggtgctgggtgatgaagagtccaccgttgttgaaaacctccagcagggggcttggctggtgggctccaggggttcttgttcctgctcctaccccaggggagccggggctgctgctgaccaaggtggtaagccagcaacccttcgtgggctaccgcggcccccgagagctgtcggaacggaagctggtgcgcaacgtgcggcaatcgggcgacgtttactacaacaccggggacgtactggccatggaccgcgaaggcttcctctacttccgcgaccgcctcggggacaccttccgatggaagggcgagaacgtgtccacgcacgaggtggagggcgtgttgtcgcaggtggacttcttgcaacaggttaacgtgtatggcgtgtgcgtgccaggttgtgagggtaaggtgggcatggctgctgtgcagctagcccccggccagactttcgacggggagaagttgtaccagcacgttcgcgcttggctccctgcctacgctaccccccatttcatccgcatccaggacgccatggaggtcaccagcacgttcaaactgatgaagacccggttggtgcgtgagggcttcaatgtggggatcgtggttgaccctctgtttgtactggacaaccgggcccagtccttccggcccctgacggcagaaatgtaccaggctgtgtgtgagggaacctggaggctctgatcacctggccaacccactggggtagggggattcaaaagcccagtcccaccccccaccgcccgacacacctccggttggttcccttttccattcctggggccctggtgtggaaattccccaacccttggcacattacccccttcaacccttcaattggggcctgggacctatcaan

SEQ ID NO: 419037 - DNA, 244 bp, Homo sapiens
tgaactcagtattgtcctgtatttcagggtgtgggggtgggtgagcacaggtgctaaaagcagcttcttacaacaatttggaagcatgacctgaaaccccctctcctgtcatctcccaggagccacctgtgttctggcccccaagttctctacttcctgcttctgggatgactgtcggcagcatggcgtgacagtgatcctgtatgtgggcgagctcctgcggtacttgtgtaacattccccag

SEQ ID NO: 419038 - DNA, 397 bp, Homo sapiens
tcaggtcatcagagtttaattttcccacaatttgaccaaaaatactaatgatgggattctttaccaaacaacatggatgcttttctctactagctgctcctctgcctgcatctgtgggtctcagatcccgcctcgcaacctcaaaggtgagccttgcctctgtttctcctctgacccatctctgcagacctccgggagagcctggaggagatccttcccaagctgcaggctgagaacatccgctgcttctacctcagccatacctcccctacaccaggggtgggggctctgggggctgccctggatgcagcgccctcccacccagtgcctgctgacctgcgtgctgggatcacatggagaagccctgccctcttcatctatacctcggggaccactg

SEQ ID NO: 419039 - DNA, 2672 bp, Homo sapiens
  misc_feature (2432)..(2432): n is a, c, g, or t
aggtaaaggtctcaggtaaagattcaggtactgaactcaagtccctcagataatacacctcatgcaagaaccccagataatgagtttcagacaaggcttccaataatggtttctttgatagctgtgctaccttgagcctcagtgtcctcatttggaaaacagggataatagcccctacccctatcatgagaatttccattaaaaattaattaaaattaaatttccattaaattaaagttctaggtaactactcttaggtgagaccccagatgaggcctccagtcacctctggtaacgtcccccaggcaaagctctgaggtcgcccctgcaggtaaccctctatttaagactccagtaactactctcatgtaagtaacccaggtagatcccttaggtagaggtcccccatcaccttccaggtaactcccaaggtaaggacccaggataacaccccctctaggtaaaggttccaaggcatgccccaagagcacctcctcctcacccttctggggacattcctgtagcaaccagaggaccggacacatacagtccgcctggcaatgggcaatggactacgggctgatgtgtgggagaccttccagcagcgcttcggtcctattcggatctgggaagtctacggctccacagaaggcaacatgggcttagtcaactatgtggggcgctgcggggccctgggcaagatgagctgcctcctccgaatgctgtccccctttgagctggtgcagttcgacatggaggcggcggagcctgtgagggacaatcagggcttctgcatccctgtagggctaggtatgggggttgaggagcctttcctgggtggcaggggtggcgaccctcagtcttctgcttggctggaacgagctgctcaaaagcttgacgttggtgctcactagaggggtctgcagccttcatctggaccctgagccagtggcctgccttaccaccatctggggcctccgcctcagcttctcggctctgtccagctcccctgccttgatctcttgctctgatttactgggtctctgggtgtccatctgatttgttctcttgagctttctgtggaagacggcattccagccattggtcccttgtcctgtaccttctgttagtgtcttctcccagggccttgcaaggtcctggtcatatctattctcactgccatttgtctgtccgtcttccatcccttgttatccttttcctgtttctcatgggctccccataccgccttctctatacttctctctcattttctgtgtcgcttgtcgcagtctctcaaggtctctgaatgtctctctcatctctggatctccctgtctgtgtctttgggtctgtccttggcagggtgctgggtgatgaagagtccaccgttgttgaaaacctccagcagggggcttggctggtgggctccaggggttcttgttcctgctcctaccccaggggagccggggctgctgctgaccaaggtggtaagccagcaacccttcgtgggctaccgcggcccccgagagctgtcggaacggaagctggtgcgcaacgtgcggcaatcgggcgacgtttactacaacaccggggacgtactggccatggaccgcgaaggcttcctctacttccgcgaccgcctcggggacaccttccgatggaagggcgagaacgtgtccacgcacgaggtggagggcgtgttgtcgcaggtggacttcttgcaacaggttaacgtgtatggcgtgtgcgtgccaggttgtgagggtaaggtgggcatggctgctgtgcagctagcccccggccagactttcgacggggagaagttgtaccagcacgttcgcgcttggctccctgcctacgctaccccccatttcatccgcatccaggacgccatggaggtcaccagcacgttcaaactgatgaagacccggttggtgcgtgagggcttcaatgtggggatcgtggttgaccctctgtttgtactggacaaccgggcccagtccttccggcccctgacggcagaaatgtaccaggctgtgtgtgagggaacctggaggctctgatcacctggccaacccactggggtagggatcaaagccagccacccccaccccaacacactcggtgtccctttcatcctgggcctgtgtgaatcccagcctggccataccctcaacctcagtgggctggaaatgacagtgggccctgtagcagtggcagaataaactcagatgtgttcacaaaaaaaaaacaaaaaaaacacaaaaaaaacaaacacagtgtgtgtgggcgcgcgcgccgcgcggcgccccccggagaaaagagctttctttagacacacacatgtcgcgtgtgtgggcgcgcgcgcgcgggcgccccggtgtggtgtgtaaggtgtggaacacagtggtgtgcgaacatagggcgggtgnccctagaagagagagagaaatccgcggggcgcagaaggaccaatgaggggcgcggggggggattctctttccagccacatatatagaaaaagacgccgcgcgggggggaaaacgacgagagaagggtttttctgtgaaaacaaattctcccaagagggggagtttatggagagggatccatcagagggggggcctctttctaacgaggggggtctcccagaggggggagccttcgaattg

SEQ ID NO: 419040 - DNA, 483 bp, Homo sapiens
gtgagcccagggtggcctggtgggtgggtggaagatcatagccagggggcgggtggatgtcacagtgattggaccatggtcactgccctgcaggacgccatggaggtcaccagcacgttcaaactgatgaagacccggttggtgcgtgagggcttcaatgtggggatcgtggttgaccctctgtttgtactggacaaccgggcccagtccttccggcccctgacggcagaaatgtaccaggctgtgtgtgagggaacctggaggctctgatcacctggccaacccactggggtagggatcaaagccagccacccccaccccaacacactcggtgtccctttcatcctgggcctgtgtgaatcccagcctggccataccctcaacctcagtgggctggaaatgacagtgggccctgtagcagtggcagaataaactcagatgtgttcacagaagtctgtatgtctgcgtggatgaaggagcaat

SEQ ID NO: 419041 - DNA, 306 bp, Homo sapiens
ggagcaggagaaacggaagccaactgtgctttcctgggtcttctgctgctctccacactgagacctcaggcccagcctctgcacagacgagtgggaaggcacagtttttgaacacccacctgaggcaaggaggtcccaggagagggagtgttgtcagcccaggccatgtcacagggagggagggagcctggtgcttggcagtcaccccacaggcactggtcagccatagaagggaacccagacctccctctaggaggcaggggcaagaagagagagagcagctccttttccttgcacccaggtctt

SEQ ID NO: 419042 - DNA, 1129 bp, Homo sapiens
tgaggttgagatgtttttcaaggctaacttcatggactcactctgtttagtgacttaattgtatcccaccaattactgctggtgacttactcacccttgtacagtgtttgcatagcagagtgaaggttacttattaccctctttctctcaagtgctttaaagaagaaacctccctggtgtttcttttctttttttttttgagacggagtcttgctttgttgcccaggctgaagtgcagtggcataatctcagctcactgaaacctctgcctcccgggttcaaacgattctcctgcctcagcctcccaagtagctgggattacaagcatgtgccaccatgcccagctaatttctgtattttagtagagacaaggtttcaccatgttggccaggctggtctcgaactcctggcctcaagtgatccacctgccttggcctcccaaagtgctccgattacaggtgtgagccacccggcccagcccctcccttgtgtttcaaccaatcggaagtgaatttaactagatgtagtaaccttttttttctttacttctaaaacagttacagtttactaataaagttaagtctggttctgtcctagaggaaataaattcactattaattcatgtcttaagttacttgggttaaaacactttcagccacccagattaattaaagtggagcagtggagcccctggctgggagatggcctccagaggagcagctgcagggcatgttctgggcttagcgacagaggcaagcaagggactggtgtctctggtgagaggtgggtttgatgtatctctgtcctatgctggtctctcttctcctttataaaatcctctgtggtcaactgactactgcgtatcgcagtggaataagactgcacagttgctggtaggtgagtttaaagtcttaatctatgcattcagagaaatatttttatatgctttgtgtaatttataacaaggattttttttttagctttgttaactgtgaattcacccctcctcctccactgcatatttaaagcatgtgttcacactgtgtgtaaacattcactgaagattttttctttgtgcattgctgactgttcaaacataacaagtattattaaaattaaatattaactg

SEQ ID NO: 419043 - DNA, 2523 bp, Homo sapiens
  misc_feature (3)..(4): n is a, c, g, or t
  misc_feature (6)..(7): n is a, c, g, or t
ggnncnnccggagccggccttcgggaggcgcggcccgggaggaggcctgggcctgcgggccgggagcagcaggggcggcccgcgggagggagcggaagtcccgggacgggcgcgggcagcggcgcgagcagggcgggcgagttccgcgctccctccccatggccgggagcgggccgcggcgacggcggcggcgctgacaggccccgggcggggcggggcaggcgggcctgggcgggggcctggggctgtgggaagatgaacgccctcctagagcagaaggagcagcaggagaggctgcgggaggccgcggccttaggggacattcgggaggtgcagaaactggtggagagcggggtggatgtgaactcccaaaatgaggtcaacggctggacttgtttacactgggcatgtaaacgaaaccatggtcaggtggtctcttacctgttaaaatcaggagctgacaaagaaattcttaccacaaaaggagaaatgccagtccagttaacatcaaggagagaaatcaggaagattatgggagtggaagaagaagatgatgatgatgatgatgatgacaacctcccccagctgaagaaggagtcagaactgccctttgttcccaactatttggccaacccagccttcccttttatctatacacccacagcagaggattcagcccagatgcagaatgggggcccctccacaccccctgcatcaccccctgcagatggctcacctccattgcttccccctggggaacctcccctgttagggacctttccccgggaccacacctctttggcactagttcagaatggtgatgtgtcggccccctctgccatactcagaacaccagaaagcacaaaaccgggtcctgtttgtcagccaccagtgagtcagagccgctccctgttttcttctgtcccgtccaagccaccaatgtctctggagcctcaaaatgggacgtatgcaggaccagcgccagcattccagccatttttcttcactggagcatttccatttaatatgcaagagctggtactcaaggtgagaattcagaacccatctcttcgagaaaatgatttcattgaaattgaactggaccgacaggagctcacctaccaagagttgctcagagtgtgttgctgtgagctgggtgttaatccagatcaagtggagaagatcagaaagttacccaatactctgttaaggaaggacaaggatgttgctcgactccaagatttccaggagctggaactggttctgatgataagtgaaaataattttctgttcagaaatgctgcatccacactgactgaaaggccttgctataacaggagagcttcaaaactgacttactaatgcagcagggacttttatcactgagtattatgacagtgtgcatcacctctgggccaaggacaagccattgatctaaatgcctcagatgcccgggagggcctctggtgccactgcatagtatatactaacatcattctgccaaggtaggaagcccctgacccccaagcagtggtgccactcttccaagcctcttggtgcacagtaaacctattgcttgaagctttgaacagctgagaagtggtctggagaggcagaagctgaaggttctatatccagtgtgttttatgtccagaatgtaagagagttgtctaagcagcagctgagagagagcggagcctatttctagccactcctgttgacagtgcacctgaagggctgggatgcgtttttcttggtgttgcatgctcacaactctgctgacattgggaacttatgagagaggaagactcgggaaagcacagatactggacagatggattctggtgtggggaaagcacagatactggacagatggattctagtgtgacttgtgactgtgaggtttcctataacatatttataaatgttactcaggttaaaagtatttaagaatacagttaactaattgtaaatatgctgttaaccaaaagagctttccctccctcactttttcctttgtaaacactcatgactgcttctctgtctcgagtcatctctgcattaactccccttcgtggtcactagagggctctctgatgccttctaaaagaacaactgcttttttacaatgccccccacccccaccccgcccatagagacagggtctcactatgtggcccaggctggtctcaaacttctggccttaagtgatgctcctgtccttggcctcccaaagtgctgggattacaggtgtgagccactgcacccagcccactttttttttactctgaagtgattccagtcatatgtgtgtgtaactgcatcctatgagaagagcacaaatattgctgttccatgttctccactttcattttccactacaaatgaaaagcaatttttgagactgaatctgttgctattttaaaggttattgtgggaaactgagctaaaggagttagcatctttatttttgtatcaaaaataaaggttattttgaaattattaggatttttacacaattct

SEQ ID NO: 419044 - DNA, 1950 bp, Homo sapiens
gagtttcatattttacagatacctttaggtccataattgttaaatctttttagggtaactcacatcctgcccatgccttctttccaaccttcttccctcttcccctgttcatgtatagtttgatacccaaacctgttcttaagactttgcctccttagctccaatggcagaagtaaattatccttctacatagctggaatggtttcccctgccttgctcttactttgtgaaccatagccttagaagtacggacgacagtgcaggaaactgccccagcagaggcagagctgggcctgagcaaaccctgctggctgcacttggttttcccaccaaacaggtctgttaatcatgcacagacctttggcatgattaagtataaccatcttctggaaaagatcttaaacaacatgggctgtgctgtgccagaactattcattaacatttctccttttttttctagagctggtactcaaggtgagaattcagaacccatctcttcgagaaaatgatttcattgaaattgaactggaccgacaggagctcacctaccaagagttgctcagagtgtgttgctgtgagctgggtgttaatccagatcaagtggagaagatcagaaagttacccaatactctgttaaggaaggacaaggatgttgctcgactccaagatttccaggagctggaactggttctgatgataagtgaaaataattttctgttcagaaatgctgcatccacactgactgaaaggccttgctataacaggagagcttcaaaactgacttactaatgcagcagggacttttatcactgagtattatgacagtgtgcatcacctctgggccaaggacaagccattgatctaaatgcctcagatgcccgggagggcctctggtgccactgcatagtatatactaacatcattctgccaaggtaggaagcccctgacccccaagcagtggtgccactcttccaagcctcttggtgcacagtaaacctattgcttgaagctttgaacagctgagaagtggtctggagaggcagaagctgaaggttctatatccagtgtgttttatgtccagaatgtaagagagttgtctaagcagcagctgagagagagcggagcctatttctagccactcctgttgacagtgcacctgaagggctgggatgcgtttttcttggtgttgcatgctcacaactctgctgacattgggaacttatgagagaggaagactcgggaaagcacagatactggacagatggattctggtgtggggaaagcacagatactggacagatggattctagtgtgacttgtgactgtgaggtttcctataacatatttataaatgttactcaggttaaaagtatttaagaatacagttaactaattgtaaatatgctgttaaccaaaagagctttccctccctcactttttcctttgtaaacactcatgactgcttctctgtctcgagtcatctctgcattaactccccttcgtggtcactagagggctctctgatgccttctaaaagaacaactgcttttttacaatgccccccacccccaccccgcccatagagacagggtctcactatgtggcccaggctggtctcaaacttctggccttaagtgatgctcctgtccttggcctcccaaagtgctgggattacaggtgtgagccactgcacccagcccactttttttttactctgaagtgattccagtcatatgtgtgtgtaactgcatcctatgagaagagcacaaatattgctgttccatgttctccactttcattttccactacaaatgaaaagcaatttttgagactgaatctgttgctattttaaaggttattgtgggaaactgagctaaaggagttagcatctttatttttgtatcaaaaataaaggttattttgaaattattaggatttttacacaattct

SEQ ID NO: 419045 - DNA, 1416 bp, Homo sapiens
  misc_feature (3)..(4): n is a, c, g, or t
  misc_feature (6)..(7): n is a, c, g, or t
ggnncnnccggagccggccttcgggaggcgcggcccgggaggaggcctgggcctgcgggccgggagcagcaggggcggcccgcgggagggagcggaagtcccgggacgggcgcgggcagcggcgcgagcagggcgggcgagttccgcgctccctccccatggccgggagcgggccgcggcgacggcggcggcgctgacaggccccgggcggggcggggcaggcgggcctgggcgggggcctggggctgtgggaagatgaacgccctcctagagcagaaggagcagcaggagaggctgcgggaggccgcggccttaggggacattcgggaggtgcagaaactggtggagagcggggtggatgtgaactcccaaaatgaggtcaacggctggacttgtttacactgggcatgtaaacgaaaccatggtcaggtggtctcttacctgttaaaatcaggagctgacaaagaaattcttaccacaaaaggagaaatgccagtccagttaacatcaaggagagaaatcaggaagattatgggagtggaagaagaagatgatgatgatgatgatgatgacaacctcccccagctgaagaaggagtcagaactgccctttgttcccaactatttggccaacccagccttcccttttatctatacacccacagcagaggattcagcccagatgcagaatgggggcccctccacaccccctgcatcaccccctgcagatggctcacctccattgcttccccctggggaacctcccctgttagggacctttccccgggaccacacctctttggcactagttcagaatggtgatgtgtcggccccctctgccatactcagaacaccagaaagcacaaaaccgggtcctgtttgtcagccaccagtgagtcagagccgctccctgttttcttctgtcccgtccaagccaccaatgtctctggagcctcaaaatgggacgtatgcaggaccagcgccagcattccagccatttttcttcactggagcatttccatttaatatgcaagagctggtactcaaggtgagaattcagaacccatctcttcgagaaaatgatttcattgaaattgaatggtctctcttctcctttataaaatcctctgtggtcaactgactactgcgtatcgcagtggaataagactgcacagttgctggtaggtgagtttaaagtcttaatctatgcattcagagaaatatttttatatgctttgtgtaatttataacaaggattttttttttagctttgttaactgtgaattcacccctcctcctccactgcatatttaaagcatgtgttcacactgtgtgtaaacattcactgaagattttttctttgtgcattgctgactgttcaaacataacaagtattattaaaattaaatattaactg

SEQ ID NO: 419046 - DNA, 2247 bp, Homo sapiens
cctggttctagctgaactctaacaggcttgtttatacattatttactaatgtttagaatctgaaatccaaaatcacttctcctctttttcaatcattattttctttggtacaggacttgtttacactgggcatgtaaacgaaaccatggtcaggtggtctcttacctgttaaaatcaggagctgacaaagaaattcttaccacaaaaggagaaatgccagtccagttaacatcaaggagagaaatcaggaagattatgggagtggaagaagaagatgatgatgatgatgatgatgacaacctcccccagctgaagaaggagtcagaactgccctttgttcccaactatttggccaacccagccttcccttttatctatacacccacagcagaggattcagcccagatgcagaatgggggcccctccacaccccctgcatcaccccctgcagatggctcacctccattgcttccccctggggaacctcccctgttagggacctttccccgggaccacacctctttggcactagttcagaatggtgatgtgtcggccccctctgccatactcagaacaccagaaagcacaaaaccgggtcctgtttgtcagccaccagtgagtcagagccgctccctgttttcttctgtcccgtccaagccaccaatgtctctggagcctcaaaatgggacgtatgcaggaccagcgccagcattccagccatttttcttcactggagcatttccatttaatatgcaagagctggtactcaaggtgagaattcagaacccatctcttcgagaaaatgatttcattgaaattgaactggaccgacaggagctcacctaccaagagttgctcagagtgtgttgctgtgagctgggtgttaatccagatcaagtggagaagatcagaaagttacccaatactctgttaaggaaggacaaggatgttgctcgactccaagatttccaggagctggaactggttctgatgataagtgaaaataattttctgttcagaaatgctgcatccacactgactgaaaggccttgctataacaggagagcttcaaaactgacttactaatgcagcagggacttttatcactgagtattatgacagtgtgcatcacctctgggccaaggacaagccattgatctaaatgcctcagatgcccgggagggcctctggtgccactgcatagtatatactaacatcattctgccaaggtaggaagcccctgacccccaagcagtggtgccactcttccaagcctcttggtgcacagtaaacctattgcttgaagctttgaacagctgagaagtggtctggagaggcagaagctgaaggttctatatccagtgtgttttatgtccagaatgtaagagagttgtctaagcagcagctgagagagagcggagcctatttctagccactcctgttgacagtgcacctgaagggctgggatgcgtttttcttggtgttgcatgctcacaactctgctgacattgggaacttatgagagaggaagactcgggaaagcacagatactggacagatggattctggtgtggggaaagcacagatactggacagatggattctagtgtgacttgtgactgtgaggtttcctataacatatttataaatgttactcaggttaaaagtatttaagaatacagttaactaattgtaaatatgctgttaaccaaaagagctttccctccctcactttttcctttgtaaacactcatgactgcttctctgtctcgagtcatctctgcattaactccccttcgtggtcactagagggctctctgatgccttctaaaagaacaactgcttttttacaatgccccccacccccaccccgcccatagagacagggtctcactatgtggcccaggctggtctcaaacttctggccttaagtgatgctcctgtccttggcctcccaaagtgctgggattacaggtgtgagccactgcacccagcccactttttttttactctgaagtgattccagtcatatgtgtgtgtaactgcatcctatgagaagagcacaaatattgctgttccatgttctccactttcattttccactacaaatgaaaagcaatttttgagactgaatctgttgctattttaaaggttattgtgggaaactgagctaaaggagttagcatctttatttttgtatcaaaaataaaggttattttgaaattattaggatttttacacaattct

SEQ ID NO: 419047 - DNA, 3642 bp, Homo sapiens
  misc_feature (269)..(269): n is a, c, g, or t
  misc_feature (275)..(275): n is a, c, g, or t
  misc_feature (277)..(278): n is a, c, g, or t
  misc_feature (351)..(351): n is a, c, g, or t
ctcaccccgctctccggccgccgccggtgcgggtgctccgctaccggctcctctccgttctgtgctctcttctgctctcggctccccaccccctctcccttccctcctctccccttgcctcccctcctctgcagcgcctgcattattttctgcccgcaggctcggcttgcactgctgctgcagcccggggaggtggctgggtgggtggggaggagactgtgcaagttgtaggggagggggtgccctcttcttccccgctcccttccccngccaantnnttcccctccttctccccctttcccctccccgcccccaccttcttcctcctttcggaagggctggtaacttgtngtgcggagcgaacggcggcggcggcggcggcggcaccatccaggcgggcaccatgggcacgtccgcgctctgggcgctctggctgctgctcgcgctgtgctgggcgccccgggagagcggcgccaccggaaccgggagaaaagccaaatgtgaaccctcccaattccagtgcacaaatggtcgctgtattacgctgttgtggaaatgtgatggggatgaagactgtgttgacggcagtgatgaaaagaactgtgtaaagaagacgtgtgctgaatctgacttcgtgtgcaacaatggccagtgtgttcccagccgatggaagtgtgatggagatcctgactgcgaagatggttcagatgaaagcccagaacagtgccatatgagaacatgccgcatacatgaaatcagctgtggcgcccattctactcagtgtatcccagtgtcctggagatgtgatggtgaaaatgattgtgacagtggagaagatgaagaaaactgtggcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtccctctcgaacttgccgacctgaccaatttgaatgtgaggatggcagctgcatccatggcagcaggcagtgtaatggtatccgagactgtgtcgatggttccgatgaagtcaactgcaaaaatgtcaatcagtgcttgggccctggaaaattcaagtgcagaagtggagaatgcatagatatcagcaaagtatgtaaccaggagcaggactgcagggactggagtgatgagcccctgaaagagtgtcatataaacgaatgcttggtaaataatggtggatgttctcatatctgcaaagacctagttataggctacgagtgtgactgtgcagctgggtttgaactgatagataggaaaacctgtggagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctggctttgtttactggtcagactggggtgaaccagctaaaatagaaaaagcaggaatgaatggattcgatagacgtccactggtgacagcggatatccagtggcctaacggaattacacttgaccttataaaaagtcgcctctattggcttgattctaagttgcacatgttatccagcgtggacttgaatggccaagatcgtaggatagtactaaagtctctggagttcctagctcatcctcttgcactaacaatatttgaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaagtactgcaactactgtgacttacagtgagacaaaagatacgaacacaacagaaatttcagcaactagtggactagttcctggagggatcaatgtgaccacagcagtatcagaggtcagtgttcccccaaaagggacttctgccgcatgggccattcttcctctcttgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcaatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatg

SEQ ID NO: 419048 - DNA, 4258 bp, Homo sapiens
  misc_feature (269)..(269): n is a, c, g, or t
  misc_feature (275)..(275): n is a, c, g, or t
  misc_feature (277)..(278): n is a, c, g, or t
  misc_feature (351)..(351): n is a, c, g, or t
ctcaccccgctctccggccgccgccggtgcgggtgctccgctaccggctcctctccgttctgtgctctcttctgctctcggctccccaccccctctcccttccctcctctccccttgcctcccctcctctgcagcgcctgcattattttctgcccgcaggctcggcttgcactgctgctgcagcccggggaggtggctgggtgggtggggaggagactgtgcaagttgtaggggagggggtgccctcttcttccccgctcccttccccngccaantnnttcccctccttctccccctttcccctccccgcccccaccttcttcctcctttcggaagggctggtaacttgtngtgcggagcgaacggcggcggcggcggcggcggcaccatccaggcgggcaccatgggcacgtccgcgctctgggcgctctggctgctgctcgcgctgtgctgggcgccccgggagagcggcgccaccggaaccgggagaaaagccaaatgtgaaccctcccaattccagtgcacaaatggtcgctgtattacgctgttgtggaaatgtgatggggatgaagactgtgttgacggcagtgatgaaaagaactgtgtaaagaagacgtgtgctgaatctgacttcgtgtgcaacaatggccagtgtgttcccagccgatggaagtgtgatggagatcctgactgcgaagatggttcagatgaaagcccagaacagtgccatatgagaacatgccgcatacatgaaatcagctgtggcgcccattctactcagtgtatcccagtgtcctggagatgtgatggtgaaaatgattgtgacagtggagaagatgaagaaaactgtggcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtccctctcgaacttgccgacctgaccaatttgaatgtgaggatggcagctgcatccatggcagcaggcagtgtaatggtatccgagactgtgtcgatggttccgatgaagtcaactgcaaaaatgtcaatcagtgcttgggccctggaaaattcaagtgcagaagtggagaatgcatagatatcagcaaagtatgtaaccaggagcaggactgcagggactggagtgatgagcccctgaaagagtgtcatataaacgaatgcttggtaaataatggtggatgttctcatatctgcaaagacctagttataggctacgagtgtgactgtgcagctgggtttgaactgatagataggaaaacctgtggagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctggctttgtttactggtcagactggggtgaaccagctaaaatagaaaaagcaggaatgaatggattcgatagacgtccactggtgacagcggatatccagtggcctaacggaattacacttggtatgtatgttcttccttctcgaccacccactcaactatcttcatagtgtttccatttatctccatggtgaattctggactagcagatgactctactgcttccgcctaaattctagcaggaattttcaatgggagtaactgaacaacacaagtaaaatggtggattaacaaattacacattccataattactggcctgttgtccagctgggcctaatatgtgacacaaattcagtgaacgttgggtcttgggtgcactcatactaaatattctgggcatgagtgccttagcatttcctgaattgcaggcttttaacagctttcttctggctttttggaggagaacaacaaaatggtagcctcttttaatattttctgtaatgtgagtaatatttcttaagtcatttgctttgagaatctcaggtaccctgttagtccccaaaaatgaacgtggatacaggctctgcatgctgcttcgcaaggtttatggtgaccccgttaagaaaccctgctggggaaagaaccgtgaaagtagattattaattcattagatatttttaatggaagccagagtagtagtggcttgtcatgtaatgcacaattcttttcctacctagaccttataaaaagtcgcctctattggcttgattctaagttgcacatgttatccagcgtggacttgaatggccaagatcgtaggatagtactaaagtctctggagttcctagctcatcctcttgcactaacaatatttgaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaagtactgcaactactgtgacttacagtgagacaaaagatacgaacacaacagaaatttcagcaactagtggactagttcctggagggatcaatgtgaccacagcagtatcagaggtcagtgttcccccaaaagggacttctgccgcatgggccattcttcctctcttgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcaatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatg

SEQ ID NO: 419049 - DNA, 3357 bp, Homo sapiens
  misc_feature (269)..(269): n is a, c, g, or t
  misc_feature (275)..(275): n is a, c, g, or t
  misc_feature (277)..(278): n is a, c, g, or t
  misc_feature (351)..(351): n is a, c, g, or t
ctcaccccgctctccggccgccgccggtgcgggtgctccgctaccggctcctctccgttctgtgctctcttctgctctcggctccccaccccctctcccttccctcctctccccttgcctcccctcctctgcagcgcctgcattattttctgcccgcaggctcggcttgcactgctgctgcagcccggggaggtggctgggtgggtggggaggagactgtgcaagttgtaggggagggggtgccctcttcttccccgctcccttccccngccaantnnttcccctccttctccccctttcccctccccgcccccaccttcttcctcctttcggaagggctggtaacttgtngtgcggagcgaacggcggcggcggcggcggcggcaccatccaggcgggcaccatgggcacgtccgcgctctgggcgctctggctgctgctcgcgctgtgctgggcgccccgggagagcggcgccaccggaaccgggagaaaagccaaatgtgaaccctcccaattccagtgcacaaatggtcgctgtattacgctgttgtggaaatgtgatggggatgaagactgtgttgacggcagtgatgaaaagaactgtgtaaagaagacgtgtgctgaatctgacttcgtgtgcaacaatggccagtgtgttcccagccgatggaagtgtgatggagatcctgactgcgaagatggttcagatgaaagcccagaacagtgccatatgagaacatgccgcatacatgaaatcagctgtggcgcccattctactcagtgtatcccagtgtcctggagatgtgatggtgaaaatgattgtgacagtggagaagatgaagaaaactgtggcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtccctctcgaacttgccgacctgaccaatttgaatgtgaggatggcagctgcatccatggcagcaggcagtgtaatggtatccgagactgtgtcgatggttccgatgaagtcaactgcaaaaatgtcaatcagtgcttgggccctggaaaattcaagtgcagaagtggagaatgcatagatatcagcaaagtatgtaaccaggagcaggactgcagggactggagtgatgagcccctgaaagagtgtcatataaacgaatgcttggtaaataatggtggatgttctcatatctgcaaagacctagttataggctacgagtgtgactgtgcagctgggtttgaactgatagataggaaaacctgtggagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggcaaagagccaagtctgatcttcactaatcgaagagacatcaggaagttcctgtttaactctgacttgcgagagcctgcctccatagctgtggacccactgtctggctttgtttactggtcagactggggtgaaccagctaaaatagaaaaagcaggaatgaatggattcgatagacgtccactggtgacagcggatatccagtggcctaacggaattacacttgaccttataaaaagtcgcctctattggcttgattctaagttgcacatgttatccagcgtggacttgaatggccaagatcgtaggatagtactaaagtctctggagttcctagctcatcctcttgcactaacaatatttgaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaagtactgcaactactgtgacttacagtgagacaaaagatacgaacacaacagaaatttcagcaactagtggactagttcctggagggatcaatgtgaccacagcagtatcagaggtcagtgttcccccaaaagggacttctgccgcatgggccattcttcctctcttgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcaatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatg

SEQ ID NO: 419050 - DNA, 1118 bp, Homo sapiens
tgatcttaaaggtttctagtagagaactgtcagtgaaatggctactacagcatgtgactcaaatacttctaagccagagttgttcctggtgttcaattgttgtagatactgaacatcaatattggatgcaaaggttttggctccttacctgatgggtaaatttctaagtctgaatacagatccttctaaactgattccttttattcctctgtagggatcaatgtgaccacagcagtatcagaggtcagtgttcccccaaaagggacttctgccgcatgggccattcttcctctcttgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcaatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatg

SEQ ID NO: 419051 - DNA, 323 bp, Homo sapiens
caggccaactagataagttatcacaaatagcctgggttttaaatgtgaaagatattaattgaaaataagttgtcaagtgactactacatttttattccagatataaacgaatgcttggtaaataatggtggatgttctcatatctgcaaagacctagttataggctacgagtgtgactgtgcagctgggtttgaactgatagataggaaaacctgtggaggtgagtctaagaagaaaacctggaccctgcaggtgatgggaaaggatagtatgtacctagtaaggtataggagcagcaagactaattctgatttccctcccag

SEQ ID NO: 419052 - DNA, 592 bp, Homo sapiens
agccttcaaaccttcctaaggctgagtttccttccactttgttggagcaagtcaagagaaaaccaggagaacatgcctagtctcctttctctgagccttcacgctaaacctcgggcaaatagtgagagccagtcctggtccctcacctcccttccccacctcctcttttggcatctgtctcttaaaggcataacttttacagtctatctcgaagaggtcccttatctggtgtccttagagcatgctgcctgtacctgtatacttattcttccttgatactgttctcacttgaaggattagcagagtagacaagtttaagctcttgggggcaaggactcaggtcttcaacatgtagaacaaggctttatatatactaggcaccggaatacccattttaatggtattttttttcctgactaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaagtaaggcattttgtgtttcaaccac

SEQ ID NO: 419053 - DNA, 565 bp, Homo sapiens
ttaaaacttgcatatcttttcctgactgatcttaaaggtttctagtagagaactgtcagtgaaatggctactacagcatgtgactcaaatacttctaagccagagttgttcctggtgttcaattgttgtagatactgaacatcaatattggatgcaaaggttttggctccttacctgatgggtaaatttctaagtctgaatacagatccttctaaactgattccttttattcctctgtagggatcaatgtgaccacagcagtatcagaggtcagtgttcccccaaaagggacttctgccgcatgggccattcttcctctctgtaagtagatttcctacaagtctgggttcaagaacttcttagataccagatgaagattttttgttcatctggagctacccctttcatgggcctttatgctgtctagcatttatgacactgaattacgttcgctttctcccccacataatacactaaattaaggcccatatctttctcttcagttgtacctttggcacagtaactggcaatgataagtgttcaacggttaatgctttctacttcc

SEQ ID NO: 419054 - DNA, 3558 bp, Homo sapiens
  misc_feature (269)..(269): n is a, c, g, or t
  misc_feature (275)..(275): n is a, c, g, or t
  misc_feature (277)..(278): n is a, c, g, or t
  misc_feature (351)..(351): n is a, c, g, or t
ctcaccccgctctccggccgccgccggtgcgggtgctccgctaccggctcctctccgttctgtgctctcttctgctctcggctccccaccccctctcccttccctcctctccccttgcctcccctcctctgcagcgcctgcattattttctgcccgcaggctcggcttgcactgctgctgcagcccggggaggtggctgggtgggtggggaggagactgtgcaagttgtaggggagggggtgccctcttcttccccgctcccttccccngccaantnnttcccctccttctccccctttcccctccccgcccccaccttcttcctcctttcggaagggctggtaacttgtngtgcggagcgaacggcggcggcggcggcggcggcaccatccaggcgggcaccatgggcacgtccgcgctctgggcgctctggctgctgctcgcgctgtgctgggcgccccgggagagcggcgccaccggaaccgggagaaaagccaaatgtgaaccctcccaattccagtgcacaaatggtcgctgtattacgctgttgtggaaatgtgatggggatgaagactgtgttgacggcagtgatgaaaagaactgtgtaaagaagacgtgtgctgaatctgacttcgtgtgcaacaatggccagtgtgttcccagccgatggaagtgtgatggagatcctgactgcgaagatggttcagatgaaagcccagaacagtgccatatgagaacatgccgcatacatgaaatcagctgtggcgcccattctactcagtgtatcccagtgtcctggagatgtgatggtgaaaatgattgtgacagtggagaagatgaagaaaactgtggcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtccctctcgaacttgccgacctgaccaatttgaatgtgaggatggcagctgcatccatggcagcaggcagtgtaatggtatccgagactgtgtcgatggttccgatgaagtcaactgcaaaaatgtcaatcagtgcttgggccctggaaaattcaagtgcagaagtggagaatgcatagatatcagcaaagtatgtaaccaggagcaggactgcagggactggagtgatgagcccctgaaagagtgtcatataaacgaatgcttggtaaataatggtggatgttctcatatctgcaaagacctagttataggctacgagtgtgactgtgcagctgggtttgaactgatagataggaaaacctgtggagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctggctttgtttactggtcagactggggtgaaccagctaaaatagaaaaagcaggaatgaatggattcgatagacgtccactggtgacagcggatatccagtggcctaacggaattacacttgaccttataaaaagtcgcctctattggcttgattctaagttgcacatgttatccagcgtggacttgaatggccaagatcgtaggatagtactaaagtctctggagttcctagctcatcctcttgcactaacaatatttgaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaaggatcaatgtgaccacagcagtatcagaggtcagtgttcccccaaaagggacttctgccgcatgggccattcttcctctcttgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcaatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatg

SEQ ID NO: 419055 - DNA, 2273 bp, Homo sapiens
caggccaactagataagttatcacaaatagcctgggttttaaatgtgaaagatattaattgaaaataagttgtcaagtgactactacatttttattccagatataaacgaatgcttggtaaataatggtggatgttctcatatctgcaaagacctagttataggctacgagtgtgactgtgcagctgggtttgaactgatagataggaaaacctgtggagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctggctttgtttactggtcagactggggtgaaccagctaaaatagaaaaagcaggaatgaatggattcgatagacgtccactggtgacagcggatatccagtggcctaacggaattacacttgaccttataaaaagtcgcctctattggcttgattctaagttgcacatgttatccagcgtggacttgaatggccaagatcgtaggatagtactaaagtctctggagttcctagctcatcctcttgcactaacaatatttgaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaagtactgcaactactgtgacttacagtgagacaaaagatacgaacacaacagaaatttcagcaactagtggactagttcctggagggatcaatgtgaccacagcagtatcagaggtcagtgttcccccaaaagggacttctgccgcatgggccattcttcctctcttgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcaatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatg

SEQ ID NO: 419056 - DNA, 232 bp, Homo sapiens
gcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcaggtaactttcagttccttttgtggtgtcttgacataagtcattgtcacttgggaagtgatc

SEQ ID NO: 419057 - DNA, 3981 bp, Homo sapiens
  misc_feature (106)..(106): n is a, c, g, or t
  misc_feature (560)..(560): n is a, c, g, or t
gcgccgcggtgcccggcgcgccctccaagctaggagaggggagaagccgggggctgcagctgggcaagggggaggaaagtgcgtgtgcgtgcacgcctgtgtgcanggcagagagtgcggggggcgacagtctcggcttagggcggaggagagggcaggggaacggcggtgcagctcccccgctgtccccgaggatttcccgcggcagccccgggctccccagtgcccctcaccatggacttgcgcggagttgggacgggcctcggcagcagcaagcggctggctgccgggccctgggggagcgcgggcgcgcgcgcggggatggcgaggtaggatggccacccagcgcgacccccgccgccccaacccagcggcccctgggcggtgccgctgactcgccggagcgcacaggggtgtgggcggaggcggcctcgccgcgcccgcgccttcgggagtcgcctcgcctcttccacccacttgcacctgccaccccgcggataccatgtcgaaggcggccggaggcgcggcggcggctgcggcggcggcggaaagttgttccncagccccggccggctcgtccgcggccccgcccgcgccggtggaggacctgtccaaagtgtcggacgaggagctgctgcagtggagcaaggaggagctgatccgcagcctgcggcgcgccgaggcggagaaggtgagcgcgatgctggaccacagcaacctcatccgcgaggtgaaccgccgcctgcagctgcacctcggcgagatccgcggcctcaaggatatcaaccagaaactccaggaagacaaccaggaactgagggacctctgctgtttcctggatgatgaccggcagaaaggcaagagggtgtctcgggagtggcagagactgggtcgctacactgccggggtgatgcacaaggaagtggccttatacctgcagaagctgaaagacctggaggtgaagcaggaggaagtggtgaaggagaacatggagctcaaggagctctgtgtgctactagatgaggagaagggtgcaggctgcgcaggcagccgctgctccatcgacagccaggccagcctgtgccaactcacagcctccaccgcaccctacgtgcgggatgtgggtgacggcagcagcacctccagcactggcagcactgacagcccggaccaccacaagcaccacgcgagcagtggcagcccggagcacctgcagaagccccggagcgagggcagcccggagcactccaagcacaggagcgccagccccgagcatccacagaaacccagagcctgtggaaccccagatcgccccaaagcactcaaaggacctagcccggagcaccacaaacccttgtgcaagggcagccccgaacagcaaaggcacccgcatccagggagcagccccgaaacgctgcccaagcacgtgctgagtgggagcccggaacacttccagaagcaccggtcagggagcagccctgaacacgccaggcacagtggagggagcccggagcatcttcagaaacacgctcttggggggagcctagagcatctccccagagccaggggcaccagcccggagcacctcaaacaacattatggagggagccctgatcacaaacacggaggaggcagtggaggaagtggaggcagcggcggaggcagcagggagggcaccctcagacggcaggcacaggaggacgggtcaccccatcaccggaatgtctacagtggcatgaacgaatcaaccttgtcctatgttaggcagctggaggcaagagtaagacagctggaggaagaaaatcgcatgctgccccaggccagccagaatagaaggcaacctccaactagaaacagctcaaatatggagaaaggctgggggtccagagcccggcgggtcttgcagtggtggcaagggtgccgaggaataggacgatgcctgcctactctcccgggttcttttaggttgtcatcaggggctgatgggagtaacagttcacccaactctgcagctagcttcagtggacatgccacaccttcccagcagcctgaacctgtggtacattctcttaaggttgtgtggaggaaacttggagatgctgcaggttcgtgtcctggaattaggcaacatttgtcaggaaaccagtacaaaggaccaatgtgagatgcactctttttcaaacaggagatcaccactgccagaaagtgatagaagacaagaagaaaaaggaaagagtgggtttccacaaacctggactcatggaataacatggagtgattgtacattgcacatatctcccctctaaaacctgtagtacaacttctcccctcaagctgatattctgtgtctctcacctcaatgtccacaacagtcaatctcaaacaaggtagctttgaacatctcaaacagagtagctttgaaaatcaacattttggtaccagtgttttcattagaaataagtgtttttaactccccagatataatattgtaattgggaaacctgaatagttttaagagtccagtggagcctcagtgttttgaatagagatgactcattacacataatggtaggagttttctaccatatcatattgaagatatgaagaggtattttccagcttcccaagtttgagagttgggcatttacctcttacacttcagtcaacaaacaaactagtaattcctaatgcataattaatttggatgcaagataagattaagtttctggagttttgttttgacttctgaggtgctaaaaaataccatgtaaattctccctaccagctagaagggtagcaagacgttgtagagtgcttatcagagagtaccatttacttcaattgatcaatataaatatatctttttttttcatcttaatgagtttctcataaagacacatcttggggcataccaaccttcatattcattcagtgtatccattggtgttaatattaacaatttcaactaaaaacaacaaacataatttttctaagtgtttcgagctgtgagatgtcaatttctacaatttagtttctagacatgctgtatatttaataaactttatgtaaactttaaaatattgcactgcatttatgaaaaaagctttctttgcctactgcagctatctaacattttatgaaactgacgcatgtccttcattattgaggctaaaagctcttgttcagattgcttgaggtttgaaaaagaggtgtgctagctttgcttagtttatttcttatttttggtatacatatacatatatataacattagaatgtgtgtactggaaatgctatgataggtattttgtgttaatccaaatgcaatgatagtttcttgtatgaatgtgcaagaggcctgtgaccgaatgctacgtttttatggtagtttaagattataaaagtagaaatgcaacaattcccagtttttggataggttctaaatttctgagatttgattcatggcagatattctctgttgttgttgttttagatgggctcattacataacgagttaattgtcactagtaggagactgtgaaggaattttgttatactttcaaaaatgttactgtgatgaaaaatcatctattttcagaaaatatttatgaattaatttactatagaattatctctctaattatcataattgggttacaatttaagctccccttttaaatgttatattttaaaatgttattactctataaaagaaaattgcttgctatatttacaccttctttcctaggaaagctttcatccttaaattgttgtattcctaccctctgaagacatttaaaataagcttttgtgcctgcagcagagcctgcagaagctaatacaagggacactggtcttttgacaaaataaacttgtgtaaattttgatactgtattaaaactatttttttaaagttctgcataaaattgagtattaagtatatgtgttcatcttagcaatggtaataaattatttaatctca

SEQ ID NO: 419058 - DNA, 2007 bp, Homo sapiens
tctggttttgccctgttctaagtaatcaaccttgtcctatgttaggcagctggaggcaagagtaagacagctggaggaagaaaatcgcatgctgccccaggttgtgtggaggaaacttggagatgctgcaggttcgtgtcctggaattaggcaacatttgtcaggaaaccagtacaaaggaccaatgtgagatgcactctttttcaaacaggagatcaccactgccagaaagtgatagaagacaagaagaaaaaggaaagagtgggtttccacaaacctggactcatggaataacatggagtgattgtacattgcacatatctcccctctaaaacctgtagtacaacttctcccctcaagctgatattctgtgtctctcacctcaatgtccacaacagtcaatctcaaacaaggtagctttgaacatctcaaacagagtagctttgaaaatcaacattttggtaccagtgttttcattagaaataagtgtttttaactccccagatataatattgtaattgggaaacctgaatagttttaagagtccagtggagcctcagtgttttgaatagagatgactcattacacataatggtaggagttttctaccatatcatattgaagatatgaagaggtattttccagcttcccaagtttgagagttgggcatttacctcttacacttcagtcaacaaacaaactagtaattcctaatgcataattaatttggatgcaagataagattaagtttctggagttttgttttgacttctgaggtgctaaaaaataccatgtaaattctccctaccagctagaagggtagcaagacgttgtagagtgcttatcagagagtaccatttacttcaattgatcaatataaatatatctttttttttcatcttaatgagtttctcataaagacacatcttggggcataccaaccttcatattcattcagtgtatccattggtgttaatattaacaatttcaactaaaaacaacaaacataatttttctaagtgtttcgagctgtgagatgtcaatttctacaatttagtttctagacatgctgtatatttaataaactttatgtaaactttaaaatattgcactgcatttatgaaaaaagctttctttgcctactgcagctatctaacattttatgaaactgacgcatgtccttcattattgaggctaaaagctcttgttcagattgcttgaggtttgaaaaagaggtgtgctagctttgcttagtttatttcttatttttggtatacatatacatatatataacattagaatgtgtgtactggaaatgctatgataggtattttgtgttaatccaaatgcaatgatagtttcttgtatgaatgtgcaagaggcctgtgaccgaatgctacgtttttatggtagtttaagattataaaagtagaaatgcaacaattcccagtttttggataggttctaaatttctgagatttgattcatggcagatattctctgttgttgttgttttagatgggctcattacataacgagttaattgtcactagtaggagactgtgaaggaattttgttatactttcaaaaatgttactgtgatgaaaaatcatctattttcagaaaatatttatgaattaatttactatagaattatctctctaattatcataattgggttacaatttaagctccccttttaaatgttatattttaaaatgttattactctataaaagaaaattgcttgctatatttacaccttctttcctaggaaagctttcatccttaaattgttgtattcctaccctctgaagacatttaaaataagcttttgtgcctgcagcagagcctgcagaagctaatacaagggacactggtcttttgacaaaataaacttgtgtaaattttgatactgtattaaaactatttttttaaagttctgcataaaattgagtattaagtatatgtgttcatcttagcaatggtaataaattatttaatctca

SEQ ID NO: 419059 - DNA, 290 bp, Homo sapiens
tgaactcattcatgtggatattttgtctcttgtctttacttcatcttcgctcctctcttaatttacccttaagaaatgcaaatctccttgtgaaagaggaaaagtaagatactcactccttctttttttttttaaggttgtgtggaggaaacttggagatgctgcaggttcgtgtcctggaattaggcaacatttgtcaggaaaccagtacaaaggaccaatgtgagatgcactctttttcaaacaggagatcaccactgccagaaagtgatagaagacaagaagaaaaa

SEQ ID NO: 419060 - DNA, 3726 bp, Homo sapiens
  misc_feature (106)..(106): n is a, c, g, or t
  misc_feature (560)..(560): n is a, c, g, or t
gcgccgcggtgcccggcgcgccctccaagctaggagaggggagaagccgggggctgcagctgggcaagggggaggaaagtgcgtgtgcgtgcacgcctgtgtgcanggcagagagtgcggggggcgacagtctcggcttagggcggaggagagggcaggggaacggcggtgcagctcccccgctgtccccgaggatttcccgcggcagccccgggctccccagtgcccctcaccatggacttgcgcggagttgggacgggcctcggcagcagcaagcggctggctgccgggccctgggggagcgcgggcgcgcgcgcggggatggcgaggtaggatggccacccagcgcgacccccgccgccccaacccagcggcccctgggcggtgccgctgactcgccggagcgcacaggggtgtgggcggaggcggcctcgccgcgcccgcgccttcgggagtcgcctcgcctcttccacccacttgcacctgccaccccgcggataccatgtcgaaggcggccggaggcgcggcggcggctgcggcggcggcggaaagttgttccncagccccggccggctcgtccgcggccccgcccgcgccggtggaggacctgtccaaagtgtcggacgaggagctgctgcagtggagcaaggaggagctgatccgcagcctgcggcgcgccgaggcggagaaggtgagcgcgatgctggaccacagcaacctcatccgcgaggtgaaccgccgcctgcagctgcacctcggcgagatccgcggcctcaaggatatcaaccagaaactccaggaagacaaccaggaactgagggacctctgctgtttcctggatgatgaccggcagaaaggcaagagggtgtctcgggagtggcagagactgggtcgctacactgccggggtgatgcacaaggaagtggccttatacctgcagaagctgaaagacctggaggtgaagcaggaggaagtggtgaaggagaacatggagctcaaggagctctgtgtgctactagatgaggagaagggtgcaggctgcgcaggcagccgctgctccatcgacagccaggccagcctgtgccaactcacagcctccaccgcaccctacgtgcgggatgtgggtgacggcagcagcacctccagcactggcagcactgacagcccggaccaccacaagcaccacgcgagcagtggcagcccggagcacctgcagaagccccggagcgagggcagcccggagcactccaagcacaggagcgccagccccgagcatccacagaaacccagagcctgtggaaccccagatcgccccaaagcactcaaaggacctagcccggagcaccacaaacccttgtgcaagggcagccccgaacagcaaaggcacccgcatccagggagcagccccgaaacgctgcccaagcacgtgctgagtgggagcccggaacacttccagaagcaccggtcagggagcagccctgaacacgccaggcacagtggagggagcccggagcatcttcagaaacacgctcttggggggagcctagagcatctccccagagccaggggcaccagcccggagcacctcaaacaacattatggagggagccctgatcacaaacacggaggaggcagtggaggaagtggaggcagcggcggaggcagcagggagggcaccctcagacggcaggcacaggaggacgggtcaccccatcaccggaatgtctacagtggcatgaacgaatcaaccttgtcctatgttaggcagctggaggcaagagtaagacagctggaggaagaaaatcgcatgctgccccaggttgtgtggaggaaacttggagatgctgcaggttcgtgtcctggaattaggcaacatttgtcaggaaaccagtacaaaggaccaatgtgagatgcactctttttcaaacaggagatcaccactgccagaaagtgatagaagacaagaagaaaaaggaaagagtgggtttccacaaacctggactcatggaataacatggagtgattgtacattgcacatatctcccctctaaaacctgtagtacaacttctcccctcaagctgatattctgtgtctctcacctcaatgtccacaacagtcaatctcaaacaaggtagctttgaacatctcaaacagagtagctttgaaaatcaacattttggtaccagtgttttcattagaaataagtgtttttaactccccagatataatattgtaattgggaaacctgaatagttttaagagtccagtggagcctcagtgttttgaatagagatgactcattacacataatggtaggagttttctaccatatcatattgaagatatgaagaggtattttccagcttcccaagtttgagagttgggcatttacctcttacacttcagtcaacaaacaaactagtaattcctaatgcataattaatttggatgcaagataagattaagtttctggagttttgttttgacttctgaggtgctaaaaaataccatgtaaattctccctaccagctagaagggtagcaagacgttgtagagtgcttatcagagagtaccatttacttcaattgatcaatataaatatatctttttttttcatcttaatgagtttctcataaagacacatcttggggcataccaaccttcatattcattcagtgtatccattggtgttaatattaacaatttcaactaaaaacaacaaacataatttttctaagtgtttcgagctgtgagatgtcaatttctacaatttagtttctagacatgctgtatatttaataaactttatgtaaactttaaaatattgcactgcatttatgaaaaaagctttctttgcctactgcagctatctaacattttatgaaactgacgcatgtccttcattattgaggctaaaagctcttgttcagattgcttgaggtttgaaaaagaggtgtgctagctttgcttagtttatttcttatttttggtatacatatacatatatataacattagaatgtgtgtactggaaatgctatgataggtattttgtgttaatccaaatgcaatgatagtttcttgtatgaatgtgcaagaggcctgtgaccgaatgctacgtttttatggtagtttaagattataaaagtagaaatgcaacaattcccagtttttggataggttctaaatttctgagatttgattcatggcagatattctctgttgttgttgttttagatgggctcattacataacgagttaattgtcactagtaggagactgtgaaggaattttgttatactttcaaaaatgttactgtgatgaaaaatcatctattttcagaaaatatttatgaattaatttactatagaattatctctctaattatcataattgggttacaatttaagctccccttttaaatgttatattttaaaatgttattactctataaaagaaaattgcttgctatatttacaccttctttcctaggaaagctttcatccttaaattgttgtattcctaccctctgaagacatttaaaataagcttttgtgcctgcagcagagcctgcagaagctaatacaagggacactggtcttttgacaaaataaacttgtgtaaattttgatactgtattaaaactatttttttaaagttctgcataaaattgagtattaagtatatgtgttcatcttagcaatggtaataaattatttaatctca

SEQ ID NO: 419061 - DNA, 1866 bp, Homo sapiens
  misc_feature (106)..(106): n is a, c, g, or t
  misc_feature (560)..(560): n is a, c, g, or t
gcgccgcggtgcccggcgcgccctccaagctaggagaggggagaagccgggggctgcagctgggcaagggggaggaaagtgcgtgtgcgtgcacgcctgtgtgcanggcagagagtgcggggggcgacagtctcggcttagggcggaggagagggcaggggaacggcggtgcagctcccccgctgtccccgaggatttcccgcggcagccccgggctccccagtgcccctcaccatggacttgcgcggagttgggacgggcctcggcagcagcaagcggctggctgccgggccctgggggagcgcgggcgcgcgcgcggggatggcgaggtaggatggccacccagcgcgacccccgccgccccaacccagcggcccctgggcggtgccgctgactcgccggagcgcacaggggtgtgggcggaggcggcctcgccgcgcccgcgccttcgggagtcgcctcgcctcttccacccacttgcacctgccaccccgcggataccatgtcgaaggcggccggaggcgcggcggcggctgcggcggcggcggaaagttgttccncagccccggccggctcgtccgcggccccgcccgcgccggtggaggacctgtccaaagtgtcggacgaggagctgctgcagtggagcaaggaggagctgatccgcagcctgcggcgcgccgaggcggagaaggtgagcgcgatgctggaccacagcaacctcatccgcgaggtgaaccgccgcctgcagctgcacctcggcgagatccgcggcctcaaggatatcaaccagaaactccaggaagacaaccaggaactgagggacctctgctgtttcctggatgatgaccggcagaaaggcaagagggtgtctcgggagtggcagagactgggtcgctacactgccggggtgatgcacaaggaagtggccttatacctgcagaagctgaaagacctggaggtgaagcaggaggaagtggtgaaggagaacatggagctcaaggagctctgtgtgctactagatgaggagaagggtgcaggctgcgcaggcagccgctgctccatcgacagccaggccagcctgtgccaactcacagcctccaccgcaccctacgtgcgggatgtgggtgacggcagcagcacctccagcactggcagcactgacagcccggaccaccacaagcaccacgcgagcagtggcagcccggagcacctgcagaagccccggagcgagggcagcccggagcactccaagcacaggagcgccagccccgagcatccacagaaacccagagcctgtggaaccccagatcgccccaaagcactcaaaggacctagcccggagcaccacaaacccttgtgcaagggcagccccgaacagcaaaggcacccgcatccagggagcagccccgaaacgctgcccaagcacgtgctgagtgggagcccggaacacttccagaagcaccggtcagggagcagccctgaacacgccaggcacagtggagggagcccggagcatcttcagaaacacgctcttggggggagcctagagcatctccccagagccaggggcaccagcccggagcacctcaaacaacattatggagggagccctgatcacaaacacggaggaggcagtggaggaagtggaggcagcggcggaggcagcagggagggcaccctcagacggcaggcacaggaggacgggtcaccccatcaccggaatgtctacagtggcatgaacggtgggtcagtatgtgctggggtgctgcttgggctggggaactcagtagagagttacgaatgatgatggactttccagccatgtaagaaagtgcaggcgctagctagggagtgggtttggggaag

SEQ ID NO: 419062 - DNA, 1964 bp, Homo sapiens
atgtcactgtgtttccttcgcaaattctctaaaatagtctgctgtgtcccggggcatagtagatattcaagaaatggtggctatgagttttatcacaattctctcctactgggtgagcagctgtttgcaagactaaaattcgggcgaggcacaggcttccccttggtcttagcagctagcacaagacgagtgtcccttcagccagtctcagagctctttggcaattcaactgacccttgtccttcagtccagacaatgccccagggcccacctgcattcaaactcggactgttctccttcccacccctattatcttttcaactttatggacagtacatgcaattttctcattcattttctcatttaacatctaacagcttcatgatatccccattttacagataaggaaaccaaggctttaagaggatagggaccctaatcggctaaggcagaattaggatttgaacccagatccccatgatgccagaatctaagccttgaccaaatatgtgttactattacttttgttgttgttgttgttctgggtaactccaaccctctgctcgttggccttgtcacctcagtgctgattttgcagatgaagagactaaggttccgaggtgctagagcacagtggttaggaacacacactctagagccagagtgcctgggtttgagcctcgttctgccgtttactagccgtatggccttgggcaacttgcttaacttctctttgcctcagttcctcttctcttgggttgttaggagaatgaatgaggtgatatccacagtgtccaacaccctgcaagcggccaggtgtggtggatcacacctgcaatcccagcactttgggaggccgaggcaggtggatcatttgaggtcaggagttcgagaccagtctggccaacatggcgaaacctcatttctactaaaaatacaaaaattagccgggcgtggtggcaaacaactgtaatccgagctactagggaggctgaggcagaagaatcgcttgaacccaggagacagaggttgcagtgagccaagattgcaccactgcactccagcctgggcgacagagtgagaccctgcctcaaaaactaaaataaaaaatgaacagtgtccaacaccttgaaagcattccgcatgactgaacgatcactgttacgtgattaccaacatgacgaccccacttctcttggccaaactgagttctcttctcttgtaaaaacttctgcatatgaagtcacccattccatttgactctttagccctcatcctggcattcaagggcatggacgactcaaccccactctctagccagcctgacctctccattcccttctctggcgtagaggccactcccaccacctgcccttaccccctgcccacttttgtcagcctgtactgtgttgaagctcccaggagagacaactgcagtcatcactttccactgtgttcagtgatgtcagttcggcccagctggaggtattcacatcatggaaacagaccatcagatttggtgtgtgtgtgttttattttgctttttcagagagccagctgttaaacactagccaacaccccattgatgctgttccttctacctgaaacacctcgcattgccggtgagctctaaagacaaaaggacctgggtctgcatttcccaaaggcaagactctggtatcacctgcatattattttcccatatttgagcaccactgccttttgcattatttacttagcagttttgctcctgtcaactcacttttttaaaactaaacttattttaaaaagaaaagttttggccgggagcggctggtctcaagctcctggactcaggtcatcctaccacctaggccttctaaagtgttaggatgagccctgaaccttgtaacatgaacatttattagttatatctggaaaaaaatataaagttatttttatttgggtgatactgccttcaaaaa

SEQ ID NO: 419063 - DNA, 568 bp, Homo sapiens
ctctcgaggacccccacgcagtatacagcctcatcttgcacagcccctccatacccagacctcacccactctatttgccatctccagaacatacccctaactttctcacctctgtgcctttgtgcaagctgctccctctacctggaaacctccatttgtcaagctgctgctgtcttcaagatctacctggtcagaatctcctgctgtcctcttctgccacccacagcaatgtgagccttcactggctggccttccctactcactggagcagagctacggcatcagaatgccctggagcaggggttagaaacacagatttctgagtctacactcgaagatttttttttctttctttctttttttttgttttccaatttttctaattttagagatggggtctcaccacgttgcccaggctggtctcaagctcctggactcaggtcatcctaccacctaggccttctaaagtgttaggatgagccctgaaccttgtaacatgaacatttattagttatatctggaaaaaaatataaagttatttttatttgggtgatactgccttcaaaaa

SEQ ID NO: 419064 - DNA, 730 bp, Homo sapiens
gcactccagcctccttgcaagcttggggcgcctcattctctcccgtgccccttctcccagctgggtctgagcccccgcccccctggctcctccgttctgcttctcccagcttctctgtccatctcccccaatggcctctctctacactctctgcctcagcttccaggtctctgctggtccctaggaagcactttgacctctgcttccccttcaaatgctgtggatcaagcctccccaaccccaccatcccaccaaagggggctgctgaccgagagagctcactcagccagctgctccctctacctggaaacctccatttgtcaagctgctgctgtcttcaagatctacctggtcagaatctcctgctgtcctcttctgccacccacagcaatgtgagccttcactggctggccttccctactcactggagcagagctacggcatcagaatgccctggagcaggggttagaaacacagatttctgagtctacactcgaagatttttttttctttctttctttttttttgttttccaatttttctaattttagagatggggtctcaccacgttgcccaggctggtctcaagctcctggactcaggtcatcctaccacctaggccttctaaagtgttaggatgagccctgaaccttgtaacatgaacatttattagttatatctggaaaaaaatataaagttatttttatttgggtgatactgccttcaaaaa

SEQ ID NO: 419065 - DNA, 363 bp, Homo sapiens
ccactgcacttcagcctgggtgacggagtgagactctgtctcaaaaaaagaaaaagaaaaagagtaccccttgccataaatagcaagcagtcattcagacatggaaatgaggcattcacacttgttcttgtttcacactaaggccctaagcctaaggagggtttctctatgttgaaaggaaattaggcagtgttcagaggggtgttaaagatagactagcaactaattgaaactttctcctcaatgtaagcactttagaagggactgaaaagagaatgttctccctacatgtaccatatcacctacaattacctcgtgtaccactattttgcaaataaatgccagaggcaagagtacattttg

SEQ ID NO: 419066 - DNA, 455 bp, Homo sapiens
cactcaaagccctcctcgatttgaatctttccagcctcatcttgcacagcccctccatacccagacctcacccactctatttgccatctcctgtcctcttctgccacccacagcaatgtgagccttcactggctggccttccctactcactggagcagagctacggcatcagaatgccctggagcaggggttagaaacacagatttctgagtctacactcgaagatttttttttctttctttctttttttttgttttccaatttttctaattttagagatggggtctcaccacgttgcccaggctggtctcaagctcctggactcaggtcatcctaccacctaggccttctaaagtgttaggatgagccctgaaccttgtaacatgaacatttattagttatatctggaaaaaaatataaagttatttttatttgggtgatactgccttcaaaaa

SEQ ID NO: 419067 - DNA, 505 bp, Homo sapiens
gcactccagcctccttgcaagcttggggcgcctcattctctcccgtgccccttctcccagctgggtctgagcccccgcccccctggctcctccgttctgcttctcccagcttctctgtccatctcccccaatggcctctctctacactctctgcctcagcttccaggtctctgctggtccctaggaagcactttgacctctgcttccccttcaaatgctgtggatcaagcctccccaaccccaccatcccaccaaagggggctgctgaccgagagagctcactcagccaggatgagggcaaaagagtttaagatggtggagccttattatgcaaaggaacccaatcccagcgtccactggaagaagactgcccaggacttctaccttcccgggaacatctgcccagagtccaccagctggaagaagactgcccaggacttctaccttcctgggaacatctgcatcagactctgtggggtagggaaataaaccttcattgtgttca

SEQ ID NO: 419068 - DNA, 281 bp, Homo sapiens
ctgggcgacagagcgagactccctctcaaaaaaaaaaaaaaaaaaaaaaagttaacatttagaataattttaaattagatttaattaaaatattatttatatattatacaaatataatgttatatttagtttaaaataatttggtttaaattaaaattttatttataaaaataactttttattttaaaaattaaagaaaataacttcacctgttccattttactttttatttttttaagagccagattcttactctgtcacccaggctggcatgatcatag

SEQ ID NO: 419069 - DNA, 908 bp, Homo sapiens
caggagacggggagtccgccagcggatggggatgtagaacgggcagcctctaatggcgcctgctggtgaggtggggtgcctgtggccatacaggaaaggggagcagctcccacctcgaggctctgtctgcctcagatgggggtctcgctctgttgcccaggctggagtgcagtggtgcaatcttggctcactgcaacctccgcctcccgggttcaagcaattctcctgcctgagcctcccgagtatctggaactacagagccagattcttactctgtcacccaggctggcatgatcatagctcacttcagcctagaactcctggcttcaagcaatcctcccacctcagcatcccaagtagctggaactacagagagccagctgttaaacactagccaacaccccattgatgctgttccttctacctgaaacacctcgcattgccggtgagctctaaagacaaaaggacctgggtctgcatttcccaaaggcaagactctggtatcacctgcatattattttcccatatttgagcaccactgccttttgcattatttacttagcagttttgctcctgtcaactcacttttttaaaactaaacttattttaaaaagaaaagttttggccgggagcggtggctcatgcctgtaatcccagcactttgggaggccgaggtgggcagatcacctgaggtcgggagttcgagaccagcctgaccaacatggagaaactccgtctctactaaaaatacaaaattagctgggcgtggtggcgcatgcctgtaatcctagctactcgggaggctgtggcaggagaattgcttgaacccaggaggcgggggttgcagtgagtcgagatcgccccattgtactccagcctggggaacaagaacgaaactccgtctcaaa

SEQ ID NO: 419070 - DNA, 889 bp, Homo sapiens
gcactccagcctccttgcaagcttggggcgcctcattctctcccgtgccccttctcccagctgggtctgagcccccgcccccctggctcctccgttctgcttctcccagcttctctgtccatctcccccaatggcctctctctacactctctgcctcagcttccaggtctctgctggtccctaggaagcactttgacctctgcttccccttcaaatgctgtggatcaagcctccccaaccccaccatcccaccaaagggggctgctgaccgagagagctcactcagccagatgggggtctcgctctgttgcccaggctggagtgcagtggtgcaatcttggctcactgcaacctccgcctcccgggttcaagcaattctcctgcctgagcctcccgagtatctggaactacagagccagattcttactctgtcacccaggctggcatgatcatagctcacttcagcctagaactcctggcttcaagcaatcctcccacctcagcatcccaagtagctggaactacagagagccagctgttaaacactagccaacaccccattgatgctgttccttctacctgaaacacctcgcattgccggtggagtctcgctctatggcccaggcaaatctcggtcactacaaactccgctcccaggttcgggcgttctccttcttcagcttctgagtagttgaacttacaggcacccgcaaaatacccatctaaattgggattatagtagagaacgacgtttcaccatggttggccaggtgtctcgaactccgggctcagcagtctccgctgggctcccaagtggttggatgcggcttagtccccgggctggcaatggattttatagcagaggacacgtaagacttctaatttctag

SEQ ID NO: 419071 - DNA, 2085 bp, Homo sapiens
atgtcactgtgtttccttcgcaaattctctaaaatagtctgctgtgtcccggggcatagtagatattcaagaaatggtggctatgagttttatcacaattctctcctactgggtgagcagctgtttgcaagactaaaattcgggcgaggcacaggcttccccttggtcttagcagctagcacaagacgagtgtcccttcagccagtctcagagctctttggcaattcaactgacccttgtccttcagtccagacaatgccccagggcccacctgcattcaaactcggactgttctccttcccacccctattatcttttcaactttatggacagtacatgcaattttctcattcattttctcatttaacatctaacagcttcatgatatccccattttacagataaggaaaccaaggctttaagaggatagggaccctaatcggctaaggcagaattaggatttgaacccagatccccatgatgccagaatctaagccttgaccaaatatgtgttactattacttttgttgttgttgttgttctgggtaactccaaccctctgctcgttggccttgtcacctcagtgctgattttgcagatgaagagactaaggttccgaggtgctagagcacagtggttaggaacacacactctagagccagagtgcctgggtttgagcctcgttctgccgtttactagccgtatggccttgggcaacttgcttaacttctctttgcctcagttcctcttctcttgggttgttaggagaatgaatgaggtgatatccacagtgtccaacaccctgcaagcggccaggtgtggtggatcacacctgcaatcccagcactttgggaggccgaggcaggtggatcatttgaggtcaggagttcgagaccagtctggccaacatggcgaaacctcatttctactaaaaatacaaaaattagccgggcgtggtggcaaacaactgtaatccgagctactagggaggctgaggcagaagaatcgcttgaacccaggagacagaggttgcagtgagccaagattgcaccactgcactccagcctgggcgacagagtgagaccctgcctcaaaaactaaaataaaaaatgaacagtgtccaacaccttgaaagcattccgcatgactgaacgatcactgttacgtgattaccaacatgacgaccccacttctcttggccaaactgagttctcttctcttgtaaaaacttctgcatatgaagtcacccattccatttgactctttagccctcatcctggcattcaagggcatggacgactcaaccccactctctagccagcctgacctctccattcccttctctggcgtagaggccactcccaccacctgcccttaccccctgcccacttttgtcagcctgtactgtgttgaagctcccaggagagacaactgcagtcatcactttccactgtgttcagtgatgtcagttcggcccagctggaggtattcacatcatggaaacagaccatcagatttggtgtgtgtgtgttttattttgctttttcagagagccagctgttaaacactagccaacaccccattgatgctgttccttctacctgaaacacctcgcattgccggtgagctctaaagacaaaaggacctgggtctgcatttcccaaaggcaagactctggtatcacctgcatattattttcccatatttgagcaccactgccttttgcattatttacttagcagttttgctcctgtcaactcacttttttaaaactaaacttattttaaaaagaaaagttttggccgggagcggtggctcatgcctgtaatcccagcactttgggaggccgaggtgggcagatcacctgaggtcgggagttcgagaccagcctgaccaacatggagaaactccgtctctactaaaaatacaaaattagctgggcgtggtggcgcatgcctgtaatcctagctactcgggaggctgtggcaggagaattgcttgaacccaggaggcgggggttgcagtgagtcgagatcgccccattgtactccagcctggggaacaagaacgaaactccgtctcaaa

SEQ ID NO: 419072 - DNA, 474 bp, Homo sapiens
ctaaacaatcaaggaagtgcagtgggctgtgtggttcttccccagccttcatccctccctgggctgtgtcatttgctgtgtgattttgaggttcctccttctaaagatgagttatgctttaaaccatacaaacagaaaactaacattggaacctaaaattactgtcaatgccaagatcattgtggttggtgcatccagtgttggaatttccttcctagagacattggtattttggtgagttgtttcactctattgattgattggtttttaaataataaaaattatcttcctacatctgaagagaacaccatcagagaacagacctgagattgtttggtactccacacaccctgcctatgtggatggatgaatcagtagaagaatattctagatcaggggttagcaaactatagccctgaggccaggcctggcttgccaactgcttttgtaaataaagctttattggaacacaaa

SEQ ID NO: 419073 - DNA, 609 bp, Homo sapiens
cgcggagaggagaggagccagaagttgagttcaaccaccagtggccaatgatttcatcaaccatgcctacacgatgaagcctccataaaaccctaaccaaagcggttaggagaacttctgggtgagaagtcatttctccagtttgtggctgaccctgtattgagaatgatacctggagtgccagctagctgacacatgtcagataggattcgagtagaatgttgcagaaacccggaggccatttctgaacactttacactactcaaggtggcaaaggagagacatggagccatttgaggcactcaatcgttgcattgcaagaaaacatggaattacatccattcctccaatgactaatatttgcttcactaatatcaaatttgcaccttgctgctcagtttctgggcctttatgggaacacaacaataagcattcatttcaatgccaaatcatgctgtaatctttttgaagacattgtcagaagcacttaaactcaacacatattgtgcgtataatgcacatgactctcttgaagtgatgacaatgaacagccatggccaagcacccatgcacaggtcagaagacttcatcatacctggcgatggatat

SEQ ID NO: 419074 - DNA, 2061 bp, Homo sapiens
  misc_feature (1545)..(1545): n is a, c, g, or t
  misc_feature (1664)..(1664): n is a, c, g, or t
  misc_feature (1923)..(1923): n is a, c, g, or t
  misc_feature (1938)..(1938): n is a, c, g, or t
  misc_feature (2012)..(2012): n is a, c, g, or t
tgcgggcagcgcgtggagtgcggcgtcctggagctgcggatgaggtgggtaacgccgtgctgactagcagcgacgcaaggactgcggtgcagggcgtccagggcgcatccccaggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagggtggaagaccatgacgatctcatgccaatatttatgcgctatgacacaattctgaaggaaacttacggtgaatacttcctggccgaactaatagaggcccaagatgaagagaatcatgctgttgtgtgtgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggtcgctggattttatgaattttgttttcagtcttttttctgataagaacttctgtgtaatttctctgccccatctcacccccgagttcttcctcatccagaatttcgtgaaaatggtccctttcaacacctgcaccctcgagcaggacctctacgtcttccaccgggctggattgctcaaaaacatttgtctgggaaggagttcatagcatcaccagngtgtcaaagggctctgtggcatgcaagagtttcagacccacggccagagtggacttttcttccttgtgctcagagctagctcggagcaccgtagccacattgcagcccacagggaaggntggaatgagaaatggaagaggggaagcactttcctcttaggggacatgaatcacctctgttcatattatgtgatcaggaacttggttgcatggccctacttagctgcaagggagcctggaagatatgttgctggtaggttgggcatgtgtccagtaaaaaactcagttgattccttaattaaaaagaagaggaaaaaggatactatgggaacattatatctagtttttatcttgtgtatgtatagaagttctaaaaagntacacaggatttcantaaccttatatgcctctgggaaacaggactgggaattgtaggtgaagatggtgactgactttgcattatgtctntctgttatgtttgatttttttgttttaattaataaactttttttttttg

SEQ ID NO: 419075 - DNA, 2019 bp, Homo sapiens
  misc_feature (1503)..(1503): n is a, c, g, or t
  misc_feature (1622)..(1622): n is a, c, g, or t
  misc_feature (1881)..(1881): n is a, c, g, or t
  misc_feature (1896)..(1896): n is a, c, g, or t
  misc_feature (1970)..(1970): n is a, c, g, or t
tgcgggcagcgcgtggagtgcggcgtcctggagctgcggatgagtggacttttttctctcttttggggacaggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagggtggaagaccatgacgatctcatgccaatatttatgcgctatgacacaattctgaaggaaacttacggtgaatacttcctggccgaactaatagaggcccaagatgaagagaatcatgctgttgtgtgtgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggtcgctggattttatgaattttgttttcagtcttttttctgataagaacttctgtgtaatttctctgccccatctcacccccgagttcttcctcatccagaatttcgtgaaaatggtccctttcaacacctgcaccctcgagcaggacctctacgtcttccaccgggctggattgctcaaaaacatttgtctgggaaggagttcatagcatcaccagngtgtcaaagggctctgtggcatgcaagagtttcagacccacggccagagtggacttttcttccttgtgctcagagctagctcggagcaccgtagccacattgcagcccacagggaaggntggaatgagaaatggaagaggggaagcactttcctcttaggggacatgaatcacctctgttcatattatgtgatcaggaacttggttgcatggccctacttagctgcaagggagcctggaagatatgttgctggtaggttgggcatgtgtccagtaaaaaactcagttgattccttaattaaaaagaagaggaaaaaggatactatgggaacattatatctagtttttatcttgtgtatgtatagaagttctaaaaagntacacaggatttcantaaccttatatgcctctgggaaacaggactgggaattgtaggtgaagatggtgactgactttgcattatgtctntctgttatgtttgatttttttgttttaattaataaactttttttttttg

SEQ ID NO: 419076 - DNA, 2167 bp, Homo sapiens
ggcttaagagagagcctcttcagaactccaagatttggatgtttttctatttttcccagaagaattcgtgttgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagagacaaggtctcattttgttgcccaggctggggtacagtggtgcaagtatggctcactgcagccttgaactctttctgggctcaagtgatcctcctacttcagcttcctgagtagctggactatagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggaggtcgctggattttatgaattttgttttcagtcttttttctgataagaacttctgtgtaatttctctgccccatctcacccccgagttcttcctcatccagaatttcgtgaaaatggtccctttcaacacctgcaccctcgagcaggacctctacgtcttccaccgggctggattgctcaagtccattaatataagatttgccactctcttggatactcctggtgtggaaaatcttgtcagcaccctcatgttgaataaaagcatattggaggacttagaccgttacaacaaggctcgcaaagaccctgacattgagtacatacggtcccattacaacattgaagatttcatctacttcagtcaccaccagcgcgaagaacacgggcacatgcatcactttgccctcaaccccattttccggcactacaccaagttctttctgaaggagatcctgcgtttaggctttaaatcctgtctctactaccgtgtttacccaaaatccagagaaggcaagttccagaacccctacgcccactccctgacatctgcccttcattacttggttcccgtgcgaccacgacgacagattgtctatcctctggaaaagcttggcataaacgctccatcaaaggcggtctccaaggatccgatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagatggaggaagagcatcagtgttattctgctgacttgcccagttgtcagggatggtgatgctgtggtgcccccttaaagggaaatgttttttcaagatttaagactgactcccagcagccagtgcataaagccatttggagtgcctgcttttgtccaccaaatagccaggataagaagtatgtggaaattagtttcctgtcttacatgtaggtgattttctccaggtctggtgcttaatgactcccccaggcacctctcaggtaggtgctcttaacactgaaatgctaggaccaagctctgggagccttcagggaaacctgacctggccaagttcatttaactctgtgtagaggcccttttcaagtaaattctcaagtaaaaaaagttaagaaaaaatgttaacatcttgccttaaaaaa

SEQ ID NO: 419077 - DNA, 1928 bp, Homo sapiens
tactcatgcctcagccttccaagtagctggtacagggaaatattgccagagaagctgcatccgaggaagctttaacagcagtccaaagtggaaatgttagtgaaccggaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggtcgctggattttatgaattttgttttcagtcttttttctgataagaacttctgtgtaatttctctgccccatctcacccccgagttcttcctcatccagaatttcgtgaaaatggtccctttcaacacctgcaccctcgagcaggacctctacgtcttccaccgggctggattgctcaagtccattaatataagatttgccactctcttggatactcctggtgtggaaaatcttgtcagcaccctcatgttgaataaaagcatattggaggacttagaccgttacaacaaggctcgcaaagaccctgacattgagtacatacggtcccattacaacattgaagatttcatctacttcagtcaccaccagcgcgaagaacacgggcacatgcatcactttgccctcaaccccattttccggcactacaccaagttctttctgaaggagatcctgcgtttaggctttaaatcctgtctctactaccgtgtttacccaaaatccagagaaggcaagttccagaacccctacgcccactccctgacatctgcccttcattacttggttcccgtgcgaccacgacgacagattgtctatcctctggaaaagcttggcataaacgctccatcaaaggcggtctccaaggatccgatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagatggaggaagagcatcagtgttattctgctgacttgcccagttgtcagggatggtgatgctgtggtgcccccttaaagggaaatgttttttcaagatttaagactgactcccagcagccagtgcataaagccatttggagtgcctgcttttgtccaccaaatagccaggataagaagtatgtggaaattagtttcctgtcttacatgtaggtgattttctccaggtctggtgcttaatgactcccccaggcacctctcaggtaggtgctcttaacactgaaatgctaggaccaagctctgggagccttcagggaaacctgacctggccaagttcatttaactctgtgtagaggcccttttcaagtaaattctcaagtaaaaaaagttaagaaaaaatgttaacatcttgccttaaaaaa

SEQ ID NO: 419078 - DNA, 1666 bp, Homo sapiens
gtaaccgttcgtacgagaatcgctgtcctctccttgcggccgccagtgtggtggaattcgaagtttcagcaaagactcaatgttgaggtgatggaacaggctcatagatttgctggaggagaattacaggtccattaatataagatttgccactctcttggatactcctggtgtggaaaatcttgtcagcaccctcatgttgaataaaagcatattggaggacttagaccgttacaacaaggctcgcaaagaccctgatggaacactgctgcaggcatttgtagctgaagttgcagaacaaatagttggtattgcagtgatcagaaatgaaatggacattgagtacatacggtcccattacaacattgaagatttcatctacttcagtcaccaccagcgcgaagaacacgggcacatgcatcactttgccctcaaccccattttccggcactacaccaagttctttctgaaggagatcctgcgtttaggctttaaatcctgtctctactaccgtgtttacccaaaatccagagaaggcaagttccagaacccctacgcccactccctgacatctgcccttcattacttggttcccgtgcgaccacgacgacagattgtctatcctctggaaaagcttggcataaacgctccatcaaaggcggtctccaaggatccgatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagatggaggaagagcatcagtgttattctgctgacttgcccagttgtcagggatggtgatgctgtggtgcccccttaaagggaaatgttttttcaagatttaagactgactcccagcagccagtgcataaagccatttggagtgcctgcttttgtccaccaaatagccaggataagaagtatgtggaaattagtttcctgtcttacatgtaggtgattttctccaggtctggtgcttaatgactcccccaggcacctctcaggtaggtgctcttaacactgaaatgctaggaccaagctctgggagccttcagggaaacctgacctggccaagttcatttaactctgtgtagaggcccttttcaagtaaattctcaagtaaaaaaagttaagaaaaaatgttaacatcttgccttaaaaaa

SEQ ID NO: 419079 - DNA, 1565 bp, Homo sapiens
cgcggagaggagaggagccagaagttgagttcaaccaccagtggccaatgatttcatcaaccatgcctacacgatgaagcctccataaaaccctaaccaaagcggttaggagaacttctgggtgagaagtcatttctccagtttgtggctgaccctgtattgagaatgatacctggagtgccagctagctgacacatgtcagataggattcgagtagaatgttgcagaaacccggaggccatttctgaacactttacactactcaaggtggcaaaggagagacatggagccatttgaggcactcaatcgttgcattgcaagaaaacatggaattacatccattcctccaatgactaatatttgcttcactaatatcaaatttgcaccttgctgctcagtttctgggcctttatgggaacacaacaataagcattcatttcaatgccaaatcatgctgtaatctttttgaagacattgtcagaagcacttaaactcaacacatattgtgcgtataatgcacatgactctcttgaagtgatgacaatgaacagccatggccaagcacccatgcacagatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagatggaggaagagcatcagtgttattctgctgacttgcccagttgtcagggatggtgatgctgtggtgcccccttaaagggaaatgttttttcaagatttaagactgactcccagcagccagtgcataaagccatttggagtgcctgcttttgtccaccaaatagccaggataagaagtatgtggaaattagtttcctgtcttacatgtaggtgattttctccaggtctggtgcttaatgactcccccaggcacctctcaggtaggtgctcttaacactgaaatgctaggaccaagctctgggagccttcagggaaacctgacctggccaagttcatttaactctgtgtagaggcccttttcaagtaaattctcaagtaaaaaaagttaagaaaaaatgttaacatcttgccttaaaaaa

SEQ ID NO: 419080 - DNA, 943 bp, Homo sapiens
cgcggagaggagaggagccagaagttgagttcaaccaccagtggccaatgatttcatcaaccatgcctacacgatgaagcctccataaaaccctaaccaaagcggttaggagaacttctgggtgagaagtcatttctccagtttgtggctgaccctgtattgagaatgatacctggagtgccagctagctgacacatgtcagataggattcgagtagaatgttgcagaaacccggaggccatttctgaacactttacactactcaaggtggcaaaggagagacatggagccatttgaggcactcaatcgttgcattgcaagaaaacatggaattacatccattcctccaatgactaatatttgcttcactaatatcaaatttgcaccttgctgctcagtttctgggcctttatgggaacacaacaataagcattcatttcaatgccaaatcatgctgtaatctttttgaagacattgtcagaagcacttaaactcaacacatattgtgcgtataatgcacatgactctcttgaagtgatgacaatgaacagccatggccaagcacccatgcacagatgagttatgctttaaaccatacaaacagaaaactaacattggaacctaaaattactgtcaatgccaagatcattgtggttggtgcatccagtgttggaatttccttcctagagacattggtattttggtgagttgtttcactctattgattgattggtttttaaataataaaaattatcttcctacatctgaagagaacaccatcagagaacagacctgagattgtttggtactccacacaccctgcctatgtggatggatgaatcagtagaagaatattctagatcaggggttagcaaactatagccctgaggccaggcctggcttgccaactgcttttgtaaataaagctttattggaacacaaa

SEQ ID NO: 419081 - DNA, 2966 bp, Homo sapiens
tgcgggcagcgcgtggagtgcggcgtcctggagctgcggatgaggtgggtaacgccgtgctgactagcagcgacgcaaggactgcggtgcagggcgtccagggcgcatccccaggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagggtggaagaccatgacgatctcatgccaatatttatgcgctatgacacaattctgaaggaaacttacggtgaatacttcctggccgaactaatagaggcccaagatgaagagaatcatgctgttgtgtgtgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggtcgctggattttatgaattttgttttcagtcttttttctgataagaacttctgtgtaatttctctgccccatctcacccccgagttcttcctcatccagaatttcgtgaaaatggtccctttcaacacctgcaccctcgagcaggacctctacgtcttccaccgggctggattgctcaagtccattaatataagatttgccactctcttggatactcctggtgtggaaaatcttgtcagcaccctcatgttgaataaaagcatattggaggacttagaccgttacaacaaggctcgcaaagaccctgacattgagtacatacggtcccattacaacattgaagatttcatctacttcagtcaccaccagcgcgaagaacacgggcacatgcatcactttgccctcaaccccattttccggcactacaccaagttctttctgaaggagatcctgcgtttaggctttaaatcctgtctctactaccgtgtttacccaaaatccagagaaggcaagttccagaacccctacgcccactccctgacatctgcccttcattacttggttcccgtgcgaccacgacgacagattgtctatcctctggaaaagcttggcataaacgctccatcaaaggcggtctccaaggatccgatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagatggaggaagagcatcagtgttattctgctgacttgcccagttgtcagggatggtgatgctgtggtgcccccttaaagggaaatgttttttcaagatttaagactgactcccagcagccagtgcataaagccatttggagtgcctgcttttgtccaccaaatagccaggataagaagtatgtggaaattagtttcctgtcttacatgtaggtgattttctccaggtctggtgcttaatgactcccccaggcacctctcaggtaggtgctcttaacactgaaatgctaggaccaagctctgggagccttcagggaaacctgacctggccaagttcatttaactctgtgtagaggcccttttcaagtaaattctcaagtaaaaaaagttaagaaaaaatgttaacatcttgccttaaaaaa

SEQ ID NO: 419082 - DNA, 1956 bp, Homo sapiens
gtaaccgttcgtacgagaatcgctgtcctctccttgcggccgccagtgtggtggaattcgaagggaaatattgccagagaagctgcatccgaggaagctttaacagcagtccaaagtggaaatgttagtgaaccggaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggtcgctggattttatgaattttgttttcagtcttttttctgataagaacttctgtgtaatttctctgccccatctcacccccgagttcttcctcatccagaatttcgtgaaaatggtccctttcaacacctgcaccctcgagcaggacctctacgtcttccaccgggctggattgctcaagtccattaatataagatttgccactctcttggatactcctggtgtggaaaatcttgtcagcaccctcatgttgaataaaagcatattggaggacttagaccgttacaacaaggctcgcaaagaccctgacattgagtacatacggtcccattacaacattgaagatttcatctacttcagtcaccaccagcgcgaagaacacgggcacatgcatcactttgccctcaaccccattttccggcactacaccaagttctttctgaaggagatcctgcgtttaggctttaaatcctgtctctactaccgtgtttacccaaaatccagagaaggcaagttccagaacccctacgcccactccctgacatctgcccttcattacttggttcccgtgcgaccacgacgacagattgtctatcctctggaaaagcttggcataaacgctccatcaaaggcggtctccaaggatccgatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagatggaggaagagcatcagtgttattctgctgacttgcccagttgtcagggatggtgatgctgtggtgcccccttaaagggaaatgttttttcaagatttaagactgactcccagcagccagtgcataaagccatttggagtgcctgcttttgtccaccaaatagccaggataagaagtatgtggaaattagtttcctgtcttacatgtaggtgattttctccaggtctggtgcttaatgactcccccaggcacctctcaggtaggtgctcttaacactgaaatgctaggaccaagctctgggagccttcagggaaacctgacctggccaagttcatttaactctgtgtagaggcccttttcaagtaaattctcaagtaaaaaaagttaagaaaaaatgttaacatcttgccttaaaaaa

SEQ ID NO: 419083 - DNA, 2499 bp, Homo sapiens
  misc_feature (3)..(5): n is a, c, g, or t
  misc_feature (7)..(7): n is a, c, g, or t
ggnnngnggcgcctgcgcagtggcggtgaccaccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctca

SEQ ID NO: 419084 - DNA, 2416 bp, Homo sapiens
  misc_feature (3)..(5): n is a, c, g, or t
  misc_feature (7)..(7): n is a, c, g, or t
ggnnngnggcgcctgcgcagtggcggtgaccaccggctcgcggcgcgtggaggctgctcccagccgcgcgcgagtcagactcgggtgggggtcccggcgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctca

SEQ ID NO: 419085 - DNA, 2348 bp, Homo sapiens
tctggtgagtggtacttcagttgtgagtccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctca

SEQ ID NO: 419086 - DNA, 2215 bp, Homo sapiens
aagacaaaggggcaggataaggagtgtgagccatctccagtgataggttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctca

SEQ ID NO: 419087 - DNA, 2605 bp, Homo sapiens
  misc_feature (3)..(5): n is a, c, g, or t
  misc_feature (7)..(7): n is a, c, g, or t
ggnnngnggcgcctgcgcagtggcggtgaccaccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctcaaaaaaaaaaacacaaaaaaacacaataaccaaaacagcacacataacacccagacaccacaaacagagtaaacacccaaccacatacaaaacagggtacccaacaa

SEQ ID NO: 419088 - DNA, 2446 bp, Homo sapiens
  misc_feature (3)..(5): n is a, c, g, or t
  misc_feature (7)..(7): n is a, c, g, or t
ggnnngnggcgcctgcgcagtggcggtgaccaccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctca

SEQ ID NO: 419089 - DNA, 2129 bp, Homo sapiens
cgggggatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatataattttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatatgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagta

SEQ ID NO: 419090 - DNA, 2310 bp, Homo sapiens
cgggggatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaactcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatataattttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatatgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaatggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattca

SEQ ID NO: 419091 - DNA, 2202 bp, Homo sapiens
cgggggatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgagctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatataattttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatatgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaatggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattca

SEQ ID NO: 419092 - DNA, 2530 bp, Homo sapiens
cgggggatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaaacttataaccatcgtaaagtgttcagaggatatgttatcacagtgggatataatgttttattttggactgcctttttacccaagcattaggttgaaattttccagttggtgagtgaaaaacactgcatattgcttcaagaatttagctaagaactaaagattaattgaacaaattacagtgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatataattttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatatgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaatggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattca

SEQ ID NO: 419093 - DNA, 2479 bp, Homo sapiens
actggctcagcccggccctgggctccgaggtggccgctcatcctgcagcaggcgagggacggggctgggcccaggctgtggcgagtcctttcgggttgtgtgacggccggcggtcacacatgccacacccccaagcctgggccgagggccatcccggtcacacataggcctctaccttggaggaagtagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaacattaggttgaaattttccagttggtgagtgaaaaacactgcatattgcttcaagaatttagctaagaactaaagattaattgaacaaattacagtgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatataattttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatatgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaatggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattca

SEQ ID NO: 419094 - DNA, 205 bp, Homo sapiens
caaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagaggtaagtctgaacatgggtggttttaagccaatgtgtgagttgtgccaatgacattggtgg

SEQ ID NO: 419095 - DNA, 2351 bp, Homo sapiens
cgggggatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatataattttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatatgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaatggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattca

SEQ ID NO: 419096 - DNA, 3715 bp, Homo sapiens
cgggggatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatataattttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatatgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaatggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattcatttactggttatcatgagtacgtgttgagatggtcatagttttttttatgactacttctagtgtatattctaatttcttttctaggcctgaatgtatctttattttcatgttataggacaatattaaggcattttaaaggtcatcatcctttcatctattttagatacacctactaaatgtttaatatatacttttggagaagtacaacataaggggagtctttaatctgtgttttccttggctgggttaatgactgtttatttaaagagtgttgtaaaattggatgtgtggtgtttaaaatggccatgtcctgaggaaacttaagtaacaaagtactaaatgctaagtaggcttttgcatattgtaactaaatttaagaataattcagattaagtagttctgaaatttggtatagatagcatagattgtctcatgctcatgagtgacataatgaccctggattctgttacatacttctaaagaaaattgattgttgtcttaggaggcagttaacttggctgaacaccaactccacactctgtcttgtttgtaggtggcagcagctgaaatctcttctcagttgttttagctttagctatgctgctggaagtctttcccatgcaagtgtgtagttcaggggtcaaccagagtttgggcagaaggaagtctgccccttctgtgcctcctgttttttgggggtttcccctttatgttccagctgttgtggttgccccatattctgccctctgatccttaaccaataaaacttggcttttgtttccccctcaagtgagaacccgttaaaaatgagacattgagccagtgctgttcactttttaagtgccaacttccctctactttccacttgtttatagttgtttccagtgcctttagttttttctaaaatatatttgttcagagtttgcagttgctatcagcaggagggttggtctgatatctgtgtgctactttgccattattggaagtgaactctgcatctttttaaaaatttgaaatcccggtatcatgtgaagtgctgtttatgtaaatctcaacatatcccttactcagggaaaaaaaagtttttagttagggaatagtgaaatataatttaatatggaattctagctgtagagttaaatccatctttaagtgtttacattcagtatgagaatgcaaatttatctgtatggggaataaagtcctaggaataaaacaagttttaagtgttcacttactgttatctactaagctgtcaatatttttgtggcttgtgaagagtgaaattaattgtccacttcattgaactgattaaaattagtaatttcaactggctgggagcggtggctcactcctgtaatcc

SEQ ID NO: 419097 - DNA, 2261 bp, Homo sapiens
cgggggatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaaccttatcagaagcttttagagaagcaaatcttgctgcgtcatttggcaaatcaatcaacttttgaattagaagattatataattttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatatgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaatggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattca

SEQ ID NO: 419098 - DNA, 2646 bp, Homo sapiens
cgggggatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaaacttataaccatcgtaaagtgttcagaggatatgttatcacagtgggatataatgttttattttggactgcctttttacccaaggtagacattttatagtgtttgataggttctgtttctgtgatacaatgatgttggccttttgtcaactataattataagttattacattttgaaactttaatactgccttttataagcattaggttgaaattttccagttggtgagtgaaaaacactgcatattgcttcaagaatttagctaagaactaaagattaattgaacaaattacagtgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatataattttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatatgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaatggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattca

SEQ ID NO: 419099 - DNA, 2312 bp, Homo sapiens
cgggggatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatataattttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatatgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaatggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattca

SEQ ID NO: 419100 - DNA, 1127 bp, Homo sapiens
  misc_feature (7)..(7): n is a, c, g, or t
agcggantcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaa

SEQ ID NO: 419101 - DNA, 1051 bp, Homo sapiens
  misc_feature (7)..(7): n is a, c, g, or t
agcggantcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagacta

SEQ ID NO: 419102 - DNA, 1423 bp, Homo sapiens
  misc_feature (7)..(7): n is a, c, g, or t
agcggantcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaaaaaaaaaaaaaaaaaaaaaaaaaaaaaaaaaaaaaaaaaaaaaaaaaaaaaaaaaaaaaaaaaaaaaaaaaacccaataaaaaaaaaaaaaaaaaaaaaaaaaaatttggggcccctttgccccaagcatttttaaacttggccaagttttttcttggggcccaatttggggctcatttggccaattccccttataagggggcctttaaaaattaatggccccgggtttccaaacgttggaattggaaaaacctggggttccccaattaggctttagaatcccctttacccttggg

SEQ ID NO: 419103 - DNA, 644 bp, Homo sapiens
tgcccccatcttctgcatgaagccttccacaaatgtctgtccattatgtttttgatttatgtaaacttttttccgagttataatattctgcaagaccatactactatcaacctctctgatctctagtgtcagtctcccagacccaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaa

SEQ ID NO: 419104 - DNA, 1151 bp, Homo sapiens
  misc_feature (7)..(7): n is a, c, g, or t
agcggantcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaacacagtacatatttgtcattttta

SEQ ID NO: 419105 - DNA, 457 bp, Homo sapiens
caggtagttgcgtttcttctcaggtagttgcgtttcttctcaggtagttgcgtttcttctcaggtagttgcgtttctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaa

SEQ ID NO: 419106 - DNA, 1047 bp, Homo sapiens
  misc_feature (7)..(7): n is a, c, g, or t
  misc_feature (1004)..(1004): n is a, c, g, or t
  misc_feature (1015)..(1015): n is a, c, g, or t
  misc_feature (1042)..(1042): n is a, c, g, or t
  misc_feature (1045)..(1045): n is a, c, g, or t
agcggantcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaactactggacccatcgcgnactactggggnaccgagcgggttttgcaaagggtttcnaantg

SEQ ID NO: 419107 - DNA, 912 bp, Homo sapiens
  misc_feature (912)..(912): n is a, c, g, or t
ctactactactactaaattgcggccgcgtcgacggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaaaaaaaaaaaaaaaaaaaaaaaaaacaaaaaaaaaaaaaaaaaaacaaaaaaagaaaacaaaaacagaaaaaaatatcaaaattcaaacaaagaaagcgacgaaagtcgagaagagaagcatgaagaagatcagagagacaagagagagagagacgatgccacaaggacgattacgtcacaggcaggaggcgaatgagtaggaaggactgcagagaaaacagaagaaaaagaggggtgctcgtactcctagagacagagctctgtagaagagaaccaatctaaaacgccgctgaacaaagaggatacaagaaaggcacgacgaatcaagcgagaagagcaagcagcaaggaaagcgacacgagcaagcagccatgcgcaggacgagagaatagagagagagatgcagcagaacagcttaagcctaacagtcggaagagatgactgcgctagagcctaagagcaagagtagcacctcaagaggaaggaggagcgagagagagcagctagagagagaagagtn

SEQ ID NO: 419108 - DNA, 934 bp, Homo sapiens
  misc_feature (7)..(7): n is a, c, g, or t
agcggantcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagacta

SEQ ID NO: 419109 - DNA, 979 bp, Homo sapiens
  misc_feature (7)..(7): n is a, c, g, or t
agcggantcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaa

SEQ ID NO: 419110 - DNA, 839 bp, Homo sapiens
  misc_feature (7)..(7): n is a, c, g, or t
agcggantcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaa

SEQ ID NO: 419111 - DNA, 1481 bp, Homo sapiens
  misc_feature (7)..(7): n is a, c, g, or t
agcggantcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaaaaaaaaaaaaaaaaaaaaaaaaaaaaaaaaaaaaaaaaaaaaaaaaaaaaaaaaaaaaaaaaagctcccgctctttaaccttatttggcaaatctgccctatggaactccggttttatattacttgactccctttataacacgttgaacctggtaataccttagctgtccccaacttagtgccttttaagcctaatcccttttccccatttgtaactttttgaaaggcccattctggctctcctttctaagagtgctcttacttaaagtcccttcgtccttcccagcgcttttttctgctatattcctcgatcattcgctctcaaacccttttttctatccttttcgctccatc

SEQ ID NO: 419112 - DNA, 1647 bp, Homo sapiens
  misc_feature (7)..(7): n is a, c, g, or t
  misc_feature (1647)..(1647): n is a, c, g, or t
agcggantcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaaaaaaaaaaaaaaaaaaaaaaaaaacaaaaaaaaaaaaaaaaaaacaaaaaaagaaaacaaaaacagaaaaaaatatcaaaattcaaacaaagaaagcgacgaaagtcgagaagagaagcatgaagaagatcagagagacaagagagagagagacgatgccacaaggacgattacgtcacaggcaggaggcgaatgagtaggaaggactgcagagaaaacagaagaaaaagaggggtgctcgtactcctagagacagagctctgtagaagagaaccaatctaaaacgccgctgaacaaagaggatacaagaaaggcacgacgaatcaagcgagaagagcaagcagcaaggaaagcgacacgagcaagcagccatgcgcaggacgagagaatagagagagagatgcagcagaacagcttaagcctaacagtcggaagagatgactgcgctagagcctaagagcaagagtagcacctcaagaggaaggaggagcgagagagagcagctagagagagaagagtn

SEQ ID NO: 419113 - DNA, 1108 bp, Homo sapiens
  misc_feature (7)..(7): n is a, c, g, or t
agcggantcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaacgcatctacctggggtcggcatca

SEQ ID NO: 419114 - DNA, 1056 bp, Homo sapiens
  misc_feature (7)..(7): n is a, c, g, or t
agcggantcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggactttagttatattcactggttttacacagagaaatacaaaataaagatcacacatcaagactatctacaaaaatttattatatatttacagaagaaaagcatgcatatcattaaacaaataaaatactttttatcacaa

SEQ ID NO: 419115 - DNA, 678 bp, Homo sapiens
  misc_feature (14)..(14): n is a, c, g, or t
  misc_feature (61)..(61): n is a, c, g, or t
  misc_feature (65)..(65): n is a, c, g, or t
ggggagctattttncacattgttagttagcgcactttgcaatatcaccaggatcatttttntaangaaaaagtatttgctgaggtgaaaaaatctgatgtttgaggaagtttttatttttatttatttgttttgttttttttttttttgaggcagactctctgtcgccaggcttctcctgcctcagcctcacgagtagctgggactacaggcatgcaccaccacgcccagctaatttttgtatttttagcagagacagggaggaagtttttatttttataaacaaaatctgatgttcagaggccccgtttcttacaataaatgttgagtcttagttaagcaggaatttatgaacacccatttcctgactttttgctttaatttagatttttctccatcctgtttctagcacaaaaatttgcctgctgtgttacaaaaataaatttatgttgtcctgtgccataaagtgatatatttaatatttttattctttggttttgaacattgtaagttcctaaaaacattttattaaacaagtagacattttgttattaaaaaaatgtgatctgtaatttctttgtgcagaatgatttgaagtattgtattcagtttacatgcattattggtttataattaatatctaatgaaaatacatgttgttatattgtaaaaaaaaaaa

SEQ ID NO: 419116 - DNA, 1376 bp, Homo sapiens
  misc_feature (449)..(449): n is a, c, g, or t
  misc_feature (463)..(463): n is a, c, g, or t
  misc_feature (466)..(466): n is a, c, g, or t
tccccagattgcagagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctagagatcgtgttggaagttgttaatatctgctacttggaacatacgattgcctttcagaataaatattggtattttttgttgttgtaaaaaaaanaaaaaaaaaaaaanaanaaaaaaaaaaaaaaaaaaaaaaaaaaaaaaaaaaaaaaaaaaaaaaaaaaaaaaaaaaaaaaacaaaagaagagaagaaacaaaaagagcagagataaaaaatatagaaaaagatcagggacaacaaaagaggacagaaaataaaacaacaaaaaaggagagagaaaaaaaaaacaacacgcgaaaaccacacagaggaaacacacagagagggaacaaaaaaggagacaaaacggagagaaaagacaagccaaaacaacaccggaaagagagacacagaaacaaagagacggacacacaaccctcaacacacaaaaaaaaagaatacaaacaaaaagcacctacaaggcggaacgcaacagacacacaaaaacaaaacaaaacgcgacgtaacacacacgagggacaaaaaaaacgacagagggaaacaaagaaaagaagacgaagaaaaggagaagaacaagaacagtagagaacaaagagaagagaacagcataaagaaacaaagggagacaggaagaagaaaaagcaatgcaagaagagaccgcagggggaggactcactacaacgggaagaagagaaaaaaagaagagcaaagaccaaccagaagagcagcaaagagaagcgaagggagaaagaagcacgcacagagaagcagaagacggacagcgcagaacacaagggaggacgcgaagagagagagagaagagaggaaagaagagagaaagagaagaaagagaaaggaagcagcagagcgagaagtaacagtaacaagacagtgagcaaggacagccgggagcaacgtagaagacgagatgagactagaaacgagagagaggagagagcgtagaagaaaaggaagaggacgaaaagaaaagaagagaaggccagaaagccaaacgaagaaagt

SEQ ID NO: 419117 - DNA, 565 bp, Homo sapiens
tccccagattgcagagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctagagatcgtgttggaagttgttaatatctgctacttggaacatacgattgcctttcagaacacgtcgaagcttcgacggtgttctgtaagtttgccctttgcagacaggctcttcaagtaagaaaacaagattgaatattttaataggatgtaggagaccgccaccgatgaggagattcaatcagacatggatgtagggtgtacgaccgcc

SEQ ID NO: 419118 - DNA, 374 bp, Homo sapiens
  misc_feature (9)..(9): n is a, c, g, or t
gcctttagnacctatttatccttttttttaagtgatgttttttaaacaccagcatcaataggacagaagaagacatctgttttccaattagctgtgtcagtagattccattcattgtttgtagttcccaatcagctttaaaaaaaaaagtttttcaaatttgcatacaagtcatctaaaatattctttggttttgaacattgtaagttcctaaaaacattttattaaacaagtagacattttgttattaaaaaaatgtgatctgtaatttctttgtgcagaatgatttgaagtattgtattcagtttacatgcattattggtttataattaatatctaatgaaaatacatgttgttatattgtaaaaaaaaaaa

SEQ ID NO: 419119 - DNA, 1482 bp, Homo sapiens
tccccagattgcagagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtgtgagtagctcggccgagatgggccttttggggccggacaagacggggctgggttggggatgatccgagcttttccaacaactaccccacgcagtcttcatctcttcacttcatctactttcctggctcgcgcccttccaggagcctttcccaccggagcctgcgaggagagactcagtgttcctgaaagtacacctttcacagcagtcttaaagtttgcagcagaagaagtaagtacagaagttggaacaacctttatggaatgcggtttgccaatatgcttcaaatgtctttaagagttgcatgcactttgacccatcatttccatgtggcttcattactaggtttatgttatcaaaaagtaggatgatagttaagacttactttcagatataagaagcatgagttaaacaaattgacatatctgattaatgcaaccattgaaaattataagaatttaatgaatttttatgagaatttttatgaaaactaaaaaggtgctgatttttaaatgttttttaaaatgcaacattatatcacattatattctatatactcatattttactagtcttgattccaaaattgcaatttcatagaatctttatcatagttttcaaattttctatatgagcatgtggactgtcagtaaaatttgttgttttgaaaagtttctagttttttaaaacatgtttgaattttctgtttcataagaaacaatttttttcatccaaaattattagaaatatctataatgcaactttttggacatgacacttgaaaaagtagcttgatctgttagaaatggcacccaaatgtgacttcggagacttagggttcctgttgtaggtgcgtcattagttagctatgtgacatgatgcaaatccctcttttttattctgcaaaatggaagtagttaatacctgtccttcctctctgatcaagtgatttcgagtaaaaacattatttcctgaaattttctgttgaagttaaaagtgctaaacaggtacgttgtaacccaaatcaaaacgttttggttcagaatcttttgaaaagtttatagtcacagaaaaataattttcttaactacattaataaaaaatagcttaacacacaatcctgccctgtacttcactgatttatggcaagtcagccaatccatcagtgctcaaagctccttgtattgtcaggaatcactaacattatttgtcactcattcagaattaaactgccaactagtagcatttgttttgtgtctgatagattcttcatgcagaaagaataagtaaaatgagatgggacac

SEQ ID NO: 419120 - DNA, 2558 bp, Homo sapiens
tccccagattgcagagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctagagatcgtgttggaagttgttaatatctgctacttggaacatacgattgcctttcagaataaatattggtattttttgttgttgtaaaattgaaatcaggcatttaacatactatgaaaacaccaggagtcaatgattaatgaaaggtgactcatctgtccctttttgttgtccatactcttcctatgaagagggaatgcgtatgaattaaggctactactgtcacagaagatcatagtctttgatgctacctcacaacacaaacaggtagttcgttgggggcaaatgaattagccaactgttaactggaagcttttgataatttttttttttagaacaatttggaacattaaaatttactgaatcgtatatattcatctgagataaaaatataaaaagaattatggaccctggatggcaatttgcttgatagcatctgatttgcagactcataatttgatttttaattaaatatataggttatgatgaagtgaatagacatatcagtgaacagttaactatattaaatttttatcatttactttttttaagattcagacctcagttatataaatttcagtttaatatcaaccaaaaaattaaaattttaatctaacccttatgtgtataaattggtgtcccataccagcttttaatggtggacctatagaatccagtacttttaatggtgggaatttacagtagaagcatcctttgctgagttatacattcctttatcaatctcttttgatacaacatttaaaacaagtagcttcaagaaaccactggtgttttgaggatagtatttctaaatagcattcaggaacagagtattattgcacagatctgaagatcaaaaaaaagctcaaggaaatacagatcggaagtgctgatgagttatatttattgaaaacccaacttttaaggaagtgctaagatcagtcacccatgtgaataagaagccaggaaaggaaagatggggaagcccagatcaccaggcttctattaaggaggaaagcaacagaggaaacagtgaaggggaacagaagggggtagcaaagtgttacagaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagacttctgcccttccggaagaaatcagtatctatgcaaatcttgaaagacgaaatcaaagcccattaatgattcagaatcagtgcttgacctcctgtattctgaatggtgaactctggaagcagggattgtgtctggctctttttagagctggaagtgtagtggctttcattaaatacttgctgtaaagtctttctaagaccaattattatcttagcatgtttcagtatcttctctatcataggccctaagttcattgggggaaaaaaaataagaagattcaacagaatcagcatttgaagtgtaccattggtagttgtttatgaaattaccagatattcataaatgtgacaaatgaacagcaggattatgaattatcaaaggaaaaagtatttgctgaggtgaaaaaatctgatgtttgaggaagtttttatttttatttatttgttttgttttttttttttttgaggcagactctctgtcgccaggcttctcctgcctcagcctcacgagtagctgggactacaggcatgcaccaccacgcccagctaatttttgtatttttagcagagacagggaggaagtttttatttttataaacaaaatctgatgttcagaggccccgtttcttacaataaatgttgagtcttagttaagcaggaatttatgaacacccatttcctgactttttgctttaatttagatttttctccatcctgtttctagcacaaaaatttgcctgctgtgttacaaaaataaatttatgttgtcctgtgccataaagtgatatatttaatatttttattctttggttttgaacattgtaagttcctaaaaacattttattaaacaagtagacattttgttattaaaaaaatgtgatctgtaatttctttgtgcagaatgatttgaagtattgtattcagtttacatgcattattggtttataattaatatctaatgaaaatacatgttgttatattgtaaaaaaaaaaa

SEQ ID NO: 419121 - DNA, 3425 bp, Homo sapiens
  misc_feature (2498)..(2498): n is a, c, g, or t
  misc_feature (2512)..(2512): n is a, c, g, or t
  misc_feature (2515)..(2515): n is a, c, g, or t
tccccagattgcagagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctagagatcgtgttggaagttgttaatatctgctacttggaacatacgattgcctttcagaataaatattggtattttttgttgttgtaaaattgaaatcaggcatttaacatactatgaaaacaccaggagtcaatgattaatgaaaggtgactcatctgtccctttttgttgtccatactcttcctatgaagagggaatgcgtatgaattaaggctactactgtcacagaagatcatagtctttgatgctacctcacaacacaaacaggtagttcgttgggggcaaatgaattagccaactgttaactggaagcttttgataatttttttttttagaacaatttggaacattaaaatttactgaatcgtatatattcatctgagataaaaatataaaaagaattatggaccctggatggcaatttgcttgatagcatctgatttgcagactcataatttgatttttaattaaatatataggttatgatgaagtgaatagacatatcagtgaacagttaactatattaaatttttatcatttactttttttaagattcagacctcagttatataaatttcagtttaatatcaaccaaaaaattaaaattttaatctaacccttatgtgtataaattggtgtcccataccagcttttaatggtggacctatagaatccagtacttttaatggtgggaatttacagtagaagcatcctttgctgagttatacattcctttatcaatctcttttgatacaacatttaaaacaagtagcttcaagaaaccactggtgttttgaggatagtatttctaaatagcattcaggaacagagtattattgcacagatctgaagatcaaaaaaaagctcaaggaaatacagatcggaagtgctgatgagttatatttattgaaaacccaacttttaaggaagtgctaagatcagtcacccatgtgaataagaagccaggaaaggaaagatggggaagcccagatcaccaggcttctattaaggaggaaagcaacagaggaaacagtgaaggggaacagaagggggtagcaaagtgttacagaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagacttcaaaataccccttatgagaatccaaagaatgatgtgtgtaagggaagattttatttgcccttccggaagaaatcagtatctatgcaaatcttgaaagacgaaatcaaagcccattaatgattcagaatcagtgcttgacctcctgtattctgaatggtgaactctggaagcagggattgtgtctggctctttttagagctggaagtgtagtggctttcattaaatacttgctgtaaagtctttctaagaccaattattatcttagcatgtttcagtatcttctctatcataggccctaagttcattgggggaaaaaaaataagaagattcaacagaatcagcatttgaagtgtaccattggtagttgtttatgaaattaccagatattcataaatgtgacaaatgaacagcaggattatgaattatcaaaggaaaaagtatttgctgaggtgaaaaaatctgatgtttgaggaagtttttatttttatttatttgttttgttttttttttttttgaggcagactctctgtcgccaggcttctcctgcctcagcctcacgagtagctgggactacaggcatgcaccaccacgcccagctaatttttgtatttttagcagagacagggaggaagtttttatttttataaacaaaatctgatgttcagaggccccgtttcttacaataaatgttgagtcttagttaagcaggaatttatgaacacccatttcctgactttttgctttaatttagatttttctccatcctgtttctagcacaaaaatttgcctgctgtgttacaaaaataaatttatgttgtcctgtgccataaagtgatatatttaatatttttattctttggttttgaacattgtaagttcctaaaaacattttattaaacaagtagacattttgttattaaaaaaaaaaanaaaaaaaaaaaaanaanaaaaaaaaaaaaaaaaaaaaaaaaaaaaaaaaaaaaaaaaaaaaaaaaaaaaaaaaaaaaaaacaaaagaagagaagaaacaaaaagagcagagataaaaaatatagaaaaagatcagggacaacaaaagaggacagaaaataaaacaacaaaaaaggagagagaaaaaaaaaacaacacgcgaaaaccacacagaggaaacacacagagagggaacaaaaaaggagacaaaacggagagaaaagacaagccaaaacaacaccggaaagagagacacagaaacaaagagacggacacacaaccctcaacacacaaaaaaaaagaatacaaacaaaaagcacctacaaggcggaacgcaacagacacacaaaaacaaaacaaaacgcgacgtaacacacacgagggacaaaaaaaacgacagagggaaacaaagaaaagaagacgaagaaaaggagaagaacaagaacagtagagaacaaagagaagagaacagcataaagaaacaaagggagacaggaagaagaaaaagcaatgcaagaagagaccgcagggggaggactcactacaacgggaagaagagaaaaaaagaagagcaaagaccaaccagaagagcagcaaagagaagcgaagggagaaagaagcacgcacagagaagcagaagacggacagcgcagaacacaagggaggacgcgaagagagagagagaagagaggaaagaagagagaaagagaagaaagagaaaggaagcagcagagcgagaagtaacagtaacaagacagtgagcaaggacagccgggagcaacgtagaagacgagatgagactagaaacgagagagaggagagagcgtagaagaaaaggaagaggacgaaaagaaaagaagagaaggccagaaagccaaacgaagaaagt

SEQ ID NO: 419122 - DNA, 2784 bp, Homo sapiens
tccccagattgcagagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtgtgagtagctcggccgagatgggccttttggggccggacaagacggggctgggttggggatgatccgagcttttccaacaactaccccacgcagtcttcatctcttcacttcatctactttcctggctcgcgcccttccaggagcctttcccaccggagcctgcgaggagagactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctagagatcgtgttggaagttgttaatatctgctacttggaacatacgattgcctttcagaataaatattggtattttttgttgttgtaaaattgaaatcaggcatttaacatactatgaaaacaccaggagtcaatgattaatgaaaggtgactcatctgtccctttttgttgtccatactcttcctatgaagagggaatgcgtatgaattaaggctactactgtcacagaagatcatagtctttgatgctacctcacaacacaaacaggtagttcgttgggggcaaatgaattagccaactgttaactggaagcttttgataatttttttttttagaacaatttggaacattaaaatttactgaatcgtatatattcatctgagataaaaatataaaaagaattatggaccctggatggcaatttgcttgatagcatctgatttgcagactcataatttgatttttaattaaatatataggttatgatgaagtgaatagacatatcagtgaacagttaactatattaaatttttatcatttactttttttaagattcagacctcagttatataaatttcagtttaatatcaaccaaaaaattaaaattttaatctaacccttatgtgtataaattggtgtcccataccagcttttaatggtggacctatagaatccagtacttttaatggtgggaatttacagtagaagcatcctttgctgagttatacattcctttatcaatctcttttgatacaacatttaaaacaagtagcttcaagaaaccactggtgttttgaggatagtatttctaaatagcattcaggaacagagtattattgcacagatctgaagatcaaaaaaaagctcaaggaaatacagatcggaagtgctgatgagttatatttattgaaaacccaacttttaaggaagtgctaagatcagtcacccatgtgaataagaagccaggaaaggaaagatggggaagcccagatcaccaggcttctattaaggaggaaagcaacagaggaaacagtgaaggggaacagaagggggtagcaaagtgttacagaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagacttcaaaataccccttatgagaatccaaagaatgatgtgtgtaagggaagattttatttgcccttccggaagaaatcagtatctatgcaaatcttgaaagacgaaatcaaagcccattaatgattcagaatcagtgcttgacctcctgtattctgaatggtgaactctggaagcagggattgtgtctggctctttttagagctggaagtgtagtggctttcattaaatacttgctgtaaagtctttctaagaccaattattatcttagcatgtttcagtatcttctctatcataggccctaagttcattgggggaaaaaaaataagaagattcaacagaatcagcatttgaagtgtaccattggtagttgtttatgaaattaccagatattcataaatgtgacaaatgaacagcaggattatgaattatcaaaggaaaaagtatttgctgaggtgaaaaaatctgatgtttgaggaagtttttatttttatttatttgttttgttttttttttttttgaggcagactctctgtcgccaggcttctcctgcctcagcctcacgagtagctgggactacaggcatgcaccaccacgcccagctaatttttgtatttttagcagagacagggaggaagtttttatttttataaacaaaatctgatgttcagaggccccgtttcttacaataaatgttgagtcttagttaagcaggaatttatgaacacccatttcctgactttttgctttaatttagatttttctccatcctgtttctagcacaaaaatttgcctgctgtgttacaaaaataaatttatgttgtcctgtgccataaagtgatatatttaatatttttattctttggttttgaacattgtaagttcctaaaaacattttattaaacaagtagacattttgttattaaaaaaatgtgatctgtaatttctttgtgcagaatgatttgaagtattgtattcagtttacatgcattattggtttataattaatatctaatgaaaatacatgttgttatattgtaaaaaaaaaaa

SEQ ID NO: 419123 - DNA, 2648 bp, Homo sapiens
tccccagattgcagagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggccttgcagttgaaattcagccataaagaaaatgaagaaatgtttttctaaaacatggttcagaactgcggattattcctagagatcgtgttggaagttgttaatatctgctacttggaacatacgattgcctttcagaataaatattggtattttttgttgttgtaaaattgaaatcaggcatttaacatactatgaaaacaccaggagtcaatgattaatgaaaggtgactcatctgtccctttttgttgtccatactcttcctatgaagagggaatgcgtatgaattaaggctactactgtcacagaagatcatagtctttgatgctacctcacaacacaaacaggtagttcgttgggggcaaatgaattagccaactgttaactggaagcttttgataatttttttttttagaacaatttggaacattaaaatttactgaatcgtatatattcatctgagataaaaatataaaaagaattatggaccctggatggcaatttgcttgatagcatctgatttgcagactcataatttgatttttaattaaatatataggttatgatgaagtgaatagacatatcagtgaacagttaactatattaaatttttatcatttactttttttaagattcagacctcagttatataaatttcagtttaatatcaaccaaaaaattaaaattttaatctaacccttatgtgtataaattggtgtcccataccagcttttaatggtggacctatagaatccagtacttttaatggtgggaatttacagtagaagcatcctttgctgagttatacattcctttatcaatctcttttgatacaacatttaaaacaagtagcttcaagaaaccactggtgttttgaggatagtatttctaaatagcattcaggaacagagtattattgcacagatctgaagatcaaaaaaaagctcaaggaaatacagatcggaagtgctgatgagttatatttattgaaaacccaacttttaaggaagtgctaagatcagtcacccatgtgaataagaagccaggaaaggaaagatggggaagcccagatcaccaggcttctattaaggaggaaagcaacagaggaaacagtgaaggggaacagaagggggtagcaaagtgttacagaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagacttcaaaataccccttatgagaatccaaagaatgatgtgtgtaagggaagattttatttgcccttccggaagaaatcagtatctatgcaaatcttgaaagacgaaatcaaagcccattaatgattcagaatcagtgcttgacctcctgtattctgaatggtgaactctggaagcagggattgtgtctggctctttttagagctggaagtgtagtggctttcattaaatacttgctgtaaagtctttctaagaccaattattatcttagcatgtttcagtatcttctctatcataggccctaagttcattgggggaaaaaaaataagaagattcaacagaatcagcatttgaagtgtaccattggtagttgtttatgaaattaccagatattcataaatgtgacaaatgaacagcaggattatgaattatcaaaggaaaaagtatttgctgaggtgaaaaaatctgatgtttgaggaagtttttatttttatttatttgttttgttttttttttttttgaggcagactctctgtcgccaggcttctcctgcctcagcctcacgagtagctgggactacaggcatgcaccaccacgcccagctaatttttgtatttttagcagagacagggaggaagtttttatttttataaacaaaatctgatgttcagaggccccgtttcttacaataaatgttgagtcttagttaagcaggaatttatgaacacccatttcctgactttttgctttaatttagatttttctccatcctgtttctagcacaaaaatttgcctgctgtgttacaaaaataaatttatgttgtcctgtgccataaagtgatatatttaatatttttattctttggttttgaacattgtaagttcctaaaaacattttattaaacaagtagacattttgttattaaaaaaatgtgatctgtaatttctttgtgcagaatgatttgaagtattgtattcagtttacatgcattattggtttataattaatatctaatgaaaatacatgttgttatattgtaaaaaaaaaaa

SEQ ID NO: 419124 - DNA, 2558 bp, Homo sapiens
tccccagattgcagagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctagagatcgtgttggaagttgttaatatctgctacttggaacatacgattgcctttcagaataaatattggtattttttgttgttgtaaaattgaaatcaggcatttaacatactatggtccatactcttcctatgaagagggaatgcgtatgaattaaggctactactgtcacagaagatcatagtctttgatgctacctcacaacacaaacaggtagttcgttgggggcaaatgaattagccaactgttaactggaagcttttgataatttttttttttagaacaatttggaacattaaaatttactgaatcgtatatattcatctgagataaaaatataaaaagaattatggaccctggatggcaatttgcttgatagcatctgatttgcagactcataatttgatttttaattaaatatataggttatgatgaagtgaatagacatatcagtgaacagttaactatattaaatttttatcatttactttttttaagattcagacctcagttatataaatttcagtttaatatcaaccaaaaaattaaaattttaatctaacccttatgtgtataaattggtgtcccataccagcttttaatggtggacctatagaatccagtacttttaatggtgggaatttacagtagaagcatcctttgctgagttatacattcctttatcaatctcttttgatacaacatttaaaacaagtagcttcaagaaaccactggtgttttgaggatagtatttctaaatagcattcaggaacagagtattattgcacagatctgaagatcaaaaaaaagctcaaggaaatacagatcggaagtgctgatgagttatatttattgaaaacccaacttttaaggaagtgctaagatcagtcacccatgtgaataagaagccaggaaaggaaagatggggaagcccagatcaccaggcttctattaaggaggaaagcaacagaggaaacagtgaaggggaacagaagggggtagcaaagtgttacagaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagacttcaaaataccccttatgagaatccaaagaatgatgtgtgtaagggaagattttatttgcccttccggaagaaatcagtatctatgcaaatcttgaaagacgaaatcaaagcccattaatgattcagaatcagtgcttgacctcctgtattctgaatggtgaactctggaagcagggattgtgtctggctctttttagagctggaagtgtagtggctttcattaaatacttgctgtaaagtctttctaagaccaattattatcttagcatgtttcagtatcttctctatcataggccctaagttcattgggggaaaaaaaataagaagattcaacagaatcagcatttgaagtgtaccattggtagttgtttatgaaattaccagatattcataaatgtgacaaatgaacagcaggattatgaattatcaaaggaaaaagtatttgctgaggtgaaaaaatctgatgtttgaggaagtttttatttttatttatttgttttgttttttttttttttgaggcagactctctgtcgccaggcttctcctgcctcagcctcacgagtagctgggactacaggcatgcaccaccacgcccagctaatttttgtatttttagcagagacagggaggaagtttttatttttataaacaaaatctgatgttcagaggccccgtttcttacaataaatgttgagtcttagttaagcaggaatttatgaacacccatttcctgactttttgctttaatttagatttttctccatcctgtttctagcacaaaaatttgcctgctgtgttacaaaaataaatttatgttgtcctgtgccataaagtgatatatttaatatttttattctttggttttgaacattgtaagttcctaaaaacattttattaaacaagtagacattttgttattaaaaaaatgtgatctgtaatttctttgtgcagaatgatttgaagtattgtattcagtttacatgcattattggtttataattaatatctaatgaaaatacatgttgttatattgtaaaaaaaaaaa

SEQ ID NO: 419125 - DNA, 2508 bp, Homo sapiens
  misc_feature (2421)..(2422): n is a, c, g, or t
  misc_feature (2431)..(2432): n is a, c, g, or t
  misc_feature (2434)..(2434): n is a, c, g, or t
  misc_feature (2462)..(2462): n is a, c, g, or t
  misc_feature (2464)..(2464): n is a, c, g, or t
  misc_feature (2482)..(2482): n is a, c, g, or t
  misc_feature (2489)..(2489): n is a, c, g, or t
  misc_feature (2493)..(2494): n is a, c, g, or t
  misc_feature (2497)..(2497): n is a, c, g, or t
  misc_feature (2499)..(2499): n is a, c, g, or t
  misc_feature (2503)..(2503): n is a, c, g, or t
tccccagattgcagagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctagagatcgtgttggaagttgttaatatctgctacttggaacatacgattgcctttcagaataaatattggtattttttgttgttgtaaaattgaaatcaggcatttaacatactatgaaaacaccaggagtcaatgattaatgaaaggtgactcatctgtccctttttgttgtccatactcttcctatgaagagggaatgcgtatgaattaaggctactactgtcacagaagatcatagtctttgatgctacctcacaacacaaacaggtagttcgttgggggcaaatgaattagccaactgttaactggaagcttttgataatttttttttttagaacaatttggaacattaaaatttactgaatcgtatatattcatctgagataaaaatataaaaagaattatggaccctggatggcaatttgcttgatagcatctgatttgcagactcataatttgatttttaattaaatatataggttatgatgaagtgaatagacatatcagtgaacagttaactatattaaatttttatcatttactttttttaagattcagacctcagttatataaatttcagtttaatatcaaccaaaaaattaaaattttaatctaacccttatgtgtataaattggtgtcccataccagcttttaatggtggacctatagaatccagtacttttaatggtgggaatttacagtagaagcatcctttgctgagttatacattcctttatcaatctcttttgatacaacatttaaaacaagtagcttcaagaaaccactggtgttttgaggatagtatttctaaatagcattcaggaacagagtattattgcacagatctgaagatcaaaaaaaagctcaaggaaatacagatcggaagtgctgatgagttatatttattgaaaacccaacttttaaggaagtgctaagatcagtcacccatgtgaataagaagccaggaaaggaaagatggggaagcccagatcaccaggcttctattaaggaggaaagcaacagaggaaacagtgaaggggaacagaagggggtagcaaagtgttacagaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagacttcaaaataccccttatgagaatccaaagaatgatgtgtgtaagggaagattttatttgcccttccggaagaaatcagtatctatgcaaatcttgaaagacgaaatcaaagcccattaatgattcagaatcagtgcttgacctcctgtattctgaatggtgaactctggaagcagggattgtgtctggctctttttagagctggaagtgtagtggctttcattaaatacttgctgtaaagtctttctaagaccaattattatcttagcatgtttcagtatcttctctatcataggccctaagttcattgggggaaaaaaaataagaagattcaacagaatcagcatttgaagtgtaccattggtagttgtttatgaaattaccagatattcataaatgtgacaaatgaacagcaggattatgaattatcaaaggaaaaagtatttgctgaggtgaaaaaatctgatgtttgaggaagtttttatttttatttatttgttttgttttttttttttttgaggcagactctctgtcgccaggcttctcctgcctcagcctcacgagtagctgggactacaggcatgcaccaccacgcccagctaatttttgtatttttagcagagacagggaggaagtttttatttttataaacaaaatctgatgttcagaggccccgtttcttacaataaatgttgagtcttagttaagcaggaatttatgaacacccatttcctgactttttgctttaatttagatttttctccatcctgtttctagcacaaaaatacaaaaattagccgggcataatggcatgcagctgtaatcccagcaactcaggagactgaggcaggagaanngcttgaacnngngaggtggaggttgcagtgagccgagatngngccattgcactccagccngggcaanagannganantccntctca

SEQ ID NO: 419126 - DNA, 2330 bp, Homo sapiens
gtcgacgaataatccgcagttctgaaccatgttttagaaaaacatttccagcagtctgtgcggattattcctagagatcgtgttggaagttgttaatatctgctacttggaacatacgattgcctttcagaataaatattggtattttttgttgttgtaaaattgaaatcaggcatttaacatactatgaaaacaccaggagtcaatgattaatgaaaggtgactcatctgtccctttttgttgtccatactcttcctatgaagagggaatgcgtatgaattaaggctactactgtcacagaagatcatagtctttgatgctacctcacaacacaaacaggtagttcgttgggggcaaatgaattagccaactgttaactggaagcttttgataatttttttttttagaacaatttggaacattaaaatttactgaatcgtatatattcatctgagataaaaatataaaaagaattatggaccctggatggcaatttgcttgatagcatctgatttgcagactcataatttgatttttaattaaatatataggttatgatgaagtgaatagacatatcagtgaacagttaactatattaaatttttatcatttactttttttaagattcagacctcagttatataaatttcagtttaatatcaaccaaaaaattaaaattttaatctaacccttatgtgtataaattggtgtcccataccagcttttaatggtggacctatagaatccagtacttttaatggtgggaatttacagtagaagcatcctttgctgagttatacattcctttatcaatctcttttgatacaacatttaaaacaagtagcttcaagaaaccactggtgttttgaggatagtatttctaaatagcattcaggaacagagtattattgcacagatctgaagatcaaaaaaaagctcaaggaaatacagatcggaagtgctgatgagttatatttattgaaaacccaacttttaaggaagtgctaagatcagtcacccatgtgaataagaagccaggaaaggaaagatggggaagcccagatcaccaggcttctattaaggaggaaagcaacagaggaaacagtgaaggggaacagaagggggtagcaaagtgttacagaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagacttcaaaataccccttatgagaatccaaagaatgatgtgtgtaagggaagattttatttgcccttccggaagaaatcagtatctatgcaaatcttgaaagacgaaatcaaagcccattaatgattcagaatcagtgcttgacctcctgtattctgaatggtgaactctggaagcagggattgtgtctggctctttttagagctggaagtgtagtggctttcattaaatacttgctgtaaagtctttctaagaccaattattatcttagcatgtttcagtatcttctctatcataggccctaagttcattgggggaaaaaaaataagaagattcaacagaatcagcatttgaagtgtaccattggtagttgtttatgaaattaccagatattcataaatgtgacaaatgaacagcaggattatgaattatcaaaggaaaaagtatttgctgaggtgaaaaaatctgatgtttgaggaagtttttatttttatttatttgttttgttttttttttttttgaggcagactctctgtcgccaggcttctcctgcctcagcctcacgagtagctgggactacaggcatgcaccaccacgcccagctaatttttgtatttttagcagagacagggaggaagtttttatttttataaacaaaatctgatgttcagaggccccgtttcttacaataaatgttgagtcttagttaagcaggaatttatgaacacccatttcctgactttttgctttaatttagatttttctccatcctgtttctagcacaaaaatttgcctgctgtgttacaaaaataaatttatgttgtcctgtgccataaagtgatatatttaatatttttattctttggttttgaacattgtaagttcctaaaaacattttattaaacaagtagacattttgttattaaaaaaatgtgatctgtaatttctttgtgcagaatgatttgaagtattgtattcagtttacatgcattattggtttataattaatatctaatgaaaatacatgttgttatattgtaaaaaaaaaaa

SEQ ID NO: 419127 - DNA, 2067 bp, Homo sapiens
tccccagattgcagagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctagagatcgtgttggaagttgttaatatctgctacttggaacatacgattgcctttcagaataaatattggtattttttgttgttgtaaaattgaaatcaggcatttaacatactatgaaaacaccaggagtcaatgattaatgaaaggtgactcatctgtccctttttgttgtccatactcttcctatgaagagggaatgcgtatgaattaaggctactactgtcacagaagatcatagtctttgatgctacctcacaacacaaacaggtagttcgttgggggcaaatgaattagccaactgttaactggaagcttttgataatttttttttttagaacaatttggaacattaaaatttactgaatcgtatatattcatctgagataaaaatataaaaagaattatggaccctggatggcaatttgcttgatagcatctgatttgcagactcataatttgatttttaattaaatatataggttatgatgaagtgaatagacatatcagtgaacagttaactatattaaatttttatcatttactttttttaagattcagacctcagttatataaatttcagtttaatatcaaccaaaaaattaaaattttaatctaacccttatgtgtataaattggtgtcccataccagcttttaatggtggacctatagaatccagtacttttaatggtgggaatttacagtagaagcatcctttgctgagttatacattcctttatcaatctcttttgatacaacatttaaaacaagtagcttcaagaaaccactggtgttttgaggatagtatttctaaatagcattcaggaacagagtattattgcacagatctgaagatcaaaaaaaagctcaaggaaatacagatcggaagtgctgatgagttatatttattgaaaacccaacttttaaggaagtgctaagatcagtcacccatgtgaataagaagccaggaaaggaaagatggggaagcccagatcaccaggcttctattaaggaggaaagcaacagaggaaacagtgaaggggaacagaagggggtagcaaagtgttacagaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagacttcaaaataccccttatgagaatccaaagaatgatgtgtgtaagggaagattttatttgcccttccggaagaaatcagtatctatgcaaatcttgaaagacgaaatcaaagcccattaatgattcagaatcagtgcttgacctcctgtattctgaatggtgaactctggaagcagggattgtgtctggctctttttagagctggaagtgtagtggctttcattaaatacttgctgtaaagtctttctaagaccaattattatcttagcatgtttcagtatcttctctatcataggccctaagttcattgggggaaaaaaaataagaagattcaacagaatcagcatttgaagtgtaccattgacattttgttattaaaaaaatgtgatctgtaatttctttgtgcagaatgatttgaagtattgtattcagtttacatgcattattggtttataattaatatctaatgaaaatacatgttgttatattgtaaaaaaaaaaa

SEQ ID NO: 419128 - DNA, 823 bp, Homo sapiens
  misc_feature (732)..(732): n is a, c, g, or t
  misc_feature (764)..(764): n is a, c, g, or t
  misc_feature (778)..(778): n is a, c, g, or t
  misc_feature (804)..(804): n is a, c, g, or t
ggggggggaagcgggggggggagggaaagggcgcaaggcaataggcgtaagacggggccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggtgagtatttgaaaactcatagaggagtgggtggggttatatatgtcaattgacactgaatagttaagctattctaattacacttgacagtattttaacataatggagctgttttttagggattatataccagtctttacctgtgtgtctgagtaataagttgtttcattgtgtatattgattgtagatgtttttggctacaagtaacagaaaacctaatagtggcttaagcattaagagtatttattatatataacaaaaagtctgtagataagattgctttctaattggagtattttttgacctacctcttaaggtagttgtgagatagtgactgtaaagtgcttcatagcttggattatttatagaaagcattcattaagtgctattattttttttaaatatagtcatttacatttcaaggggctgagtctacattcagatcttcaaactgtaactatcagtgattatggngctgacagaacagtaaagagctatactataangagctaactttaantagttatattaaatgacctagctaanctaagtaaatagctgctaa

SEQ ID NO: 419129 - DNA, 769 bp, Homo sapiens
  misc_feature (678)..(678): n is a, c, g, or t
  misc_feature (710)..(710): n is a, c, g, or t
  misc_feature (724)..(724): n is a, c, g, or t
  misc_feature (750)..(750): n is a, c, g, or t
ggggggggaagcgggggggggagggaaagggcgcaaggcaataggcgtaagacggggccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggtgagtatttgaaaactcatagaggagtgggtggggttatatatgtcaattgacactgaatagttaagctattctaattacacttgacagtattttaacataatggagctgttttttagggattatataccagtctttacctgtgtgtctgagtaataagttgtttcattgtgtatattgattgtagatgtttttggctacaaaaaaagtctgtagataagattgctttctaattggagtattttttgacctacctcttaaggtagttgtgagatagtgactgtaaagtgcttcatagcttggattatttatagaaagcattcattaagtgctattattttttttaaatatagtcatttacatttcaaggggctgagtctacattcagatcttcaaactgtaactatcagtgattatggngctgacagaacagtaaagagctatactataangagctaactttaantagttatattaaatgacctagctaanctaagtaaatagctgctaa

SEQ ID NO: 419130 - DNA, 227 bp, Homo sapiens
ctggtccagctgcccgaccctgactctctcccgctcttttcctcaggtcgaaggtttcctttaagatcacgctgacgtcggacccacggctgccgtacaaagtgtgagtagctcggccgagatgggccttttggggccggacaagacggggctgggttggggatgatccgagcttttccaacaactaccccacgcagtcttcatctcttcacttcatctactttcct

SEQ ID NO: 419131 - DNA, 2612 bp, Homo sapiens
tccccagattgcagagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctagagatcgtgttggaagttgttaatatctgctacttggaacatacgattgcctttcagaataaatattggtattttttgttgttgtaaaattgaaatcaggcatttaacatactatgaaaacaccaggagtcaatgattaatgaaaggtgactcatctgtccctttttgttgtccatactcttcctatgaagagggaatgcgtatgaattaaggctactactgtcacagaagatcatagtctttgatgctacctcacaacacaaacaggtagttcgttgggggcaaatgaattagccaactgttaactggaagcttttgataatttttttttttagaacaatttggaacattaaaatttactgaatcgtatatattcatctgagataaaaatataaaaagaattatggaccctggatggcaatttgcttgatagcatctgatttgcagactcataatttgatttttaattaaatatataggttatgatgaagtgaatagacatatcagtgaacagttaactatattaaatttttatcatttactttttttaagattcagacctcagttatataaatttcagtttaatatcaaccaaaaaattaaaattttaatctaacccttatgtgtataaattggtgtcccataccagcttttaatggtggacctatagaatccagtacttttaatggtgggaatttacagtagaagcatcctttgctgagttatacattcctttatcaatctcttttgatacaacatttaaaacaagtagcttcaagaaaccactggtgttttgaggatagtatttctaaatagcattcaggaacagagtattattgcacagatctgaagatcaaaaaaaagctcaaggaaatacagatcggaagtgctgatgagttatatttattgaaaacccaacttttaaggaagtgctaagatcagtcacccatgtgaataagaagccaggaaaggaaagatggggaagcccagatcaccaggcttctattaaggaggaaagcaacagaggaaacagtgaaggggaacagaagggggtagcaaagtgttacagaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagacttcaaaataccccttatgagaatccaaagaatgatgtgtgtaagggaagattttatttgcccttccggaagaaatcagtatctatgcaaatcttgaaagacgaaatcaaagcccattaatgattcagaatcagtgcttgacctcctgtattctgaatggtgaactctggaagcagggattgtgtctggctctttttagagctggaagtgtagtggctttcattaaatacttgctgtaaagtctttctaagaccaattattatcttagcatgtttcagtatcttctctatcataggccctaagttcattgggggaaaaaaaataagaagattcaacagaatcagcatttgaagtgtaccattggtagttgtttatgaaattaccagatattcataaatgtgacaaatgaacagcaggattatgaattatcaaaggaaaaagtatttgctgaggtgaaaaaatctgatgtttgaggaagtttttatttttatttatttgttttgttttttttttttttgaggcagactctctgtcgccaggcttctcctgcctcagcctcacgagtagctgggactacaggcatgcaccaccacgcccagctaatttttgtatttttagcagagacagggaggaagtttttatttttataaacaaaatctgatgttcagaggccccgtttcttacaataaatgttgagtcttagttaagcaggaatttatgaacacccatttcctgactttttgctttaatttagatttttctccatcctgtttctagcacaaaaatttgcctgctgtgttacaaaaataaatttatgttgtcctgtgccataaagtgatatatttaatatttttattctttggttttgaacattgtaagttcctaaaaacattttattaaacaagtagacattttgttattaaaaaaatgtgatctgtaatttctttgtgcagaatgatttgaagtattgtattcagtttacatgcattattggtttataattaatatctaatgaaaatacatgttgttatattgtaaaaaaaaaaa

SEQ ID NO: 419132 - DNA, 948 bp, Homo sapiens
tccccagattgcagagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctagagatcgtgttggaagttgttaatatctgctacttggaacatacgattgcctttcagaataaatattggtattttttgttgttgtaaaattgaaatcaggcatttaacatactatgaaaacaccaggagtcaatgattaatgaaaggtgactcatctgtccctttttgttgtccatactcttcctatgaagagggaatgcgtatgaattaaggctactactgtcacagaagatcatagtctttgatgctacctcacaacacaaacaggtagttcgttgggggcaaatgaattagccaactgttaactggaagcttttgataatttttttttttagaacaatttggaacattaaaatttactgaatcgtatatattcatctgagataaaaatataaaaagaattatggaccctggatggcaatttgcttgatagcatctgatttgcagactcataatttgatttttaattaaatatataggttatgatgaagtgaatagacatatcagtgaacagttaactatattaaatttttatcatttactttttttaagattcagacctcagttatataaatttcagtttaatatcaacc

SEQ ID NO: 419133 - DNA, 1310 bp, Homo sapiens
tccccagattgcagagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaagtaagtacagaagttggaacaacctttatggaatgcggtttgccaatatgcttcaaatgtctttaagagttgcatgcactttgacccatcatttccatgtggcttcattactaggtttatgttatcaaaaagtaggatgatagttaagacttactttcagatataagaagcatgagttaaacaaattgacatatctgattaatgcaaccattgaaaattataagaatttaatgaatttttatgagaatttttatgaaaactaaaaaggtgctgatttttaaatgttttttaaaatgcaacattatatcacattatattctatatactcatattttactagtcttgattccaaaattgcaatttcatagaatctttatcatagttttcaaattttctatatgagcatgtggactgtcagtaaaatttgttgttttgaaaagtttctagttttttaaaacatgtttgaattttctgtttcataagaaacaatttttttcatccaaaattattagaaatatctataatgcaactttttggacatgacacttgaaaaagtagcttgatctgttagaaatggcacccaaatgtgacttcggagacttagggttcctgttgtaggtgcgtcattagttagctatgtgacatgatgcaaatccctcttttttattctgcaaaatggaagtagttaatacctgtccttcctctctgatcaagtgatttcgagtaaaaacattatttcctgaaattttctgttgaagttaaaagtgctaaacaggtacgttgtaacccaaatcaaaacgttttggttcagaatcttttgaaaagtttatagtcacagaaaaataattttcttaactacattaataaaaaatagcttaacacacaatcctgccctgtacttcactgatttatggcaagtcagccaatccatcagtgctcaaagctccttgtattgtcaggaatcactaacattatttgtcactcattcagaattaaactgccaactagtagcatttgttttgtgtctgatagattcttcatgcagaaagaataagtaaaatgagatgggacac

SEQ ID NO: 419134 - DNA, 3277 bp, Homo sapiens
tccccagattgcagagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggccttgcagttgaaattcagccataaagaaaatgaagtgatttaaaattgcaaatttttgttacttcagtagttgttaatatataattttattaaaaaggtttattgaaaatcgtgaggcactttattgtatggatgcctttaaacttagtagacaaaggtttctttttttcttaatcgagaaactttcaatattttacagtagtttgaattactgctaactctaacatactgcttgttttattatctttaaaaattgaatgtgcatatccttgatatgaagaaaatctcatcaggcaattgaccccaaatatgtcagggtatctaaatttttgtcacttgtagtaatttacattttttttcctgtccttagatatattattgtgtttgaaggaagtattcatgattaattattcacagttcttgatgaaagtttcgtcagagttttcatggctggtgttattttaattttaagcgtatgttggattgtgaagataggagaataggaacaagacttaaaaagcttggaattggggtctcatgatgcttgagcttttgtacccattttactgtttactaaatcatttattatatttaataattgtcagaatattaagataacttgatttttagatatctaactttatgttttgtttgtttgtataggaaatgtttttctaaaacatggttcagaactgcggattattcctagagatcgtgttggaagttgttaatatctgctacttggaacatacgattgcctttcagaataaatattggtattttttgttgttgtaaaattgaaatcaggcatttaacatactatgaaaacaccaggagtcaatgattaatgaaaggtgactcatctgtccctttttgttgtccatactcttcctatgaagagggaatgcgtatgaattaaggctactactgtcacagaagatcatagtctttgatgctacctcacaacacaaacaggtagttcgttgggggcaaatgaattagccaactgttaactggaagcttttgataatttttttttttagaacaatttggaacattaaaatttactgaatcgtatatattcatctgagataaaaatataaaaagaattatggaccctggatggcaatttgcttgatagcatctgatttgcagactcataatttgatttttaattaaatatataggttatgatgaagtgaatagacatatcagtgaacagttaactatattaaatttttatcatttactttttttaagattcagacctcagttatataaatttcagtttaatatcaaccaaaaaattaaaattttaatctaacccttatgtgtataaattggtgtcccataccagcttttaatggtggacctatagaatccagtacttttaatggtgggaatttacagtagaagcatcctttgctgagttatacattcctttatcaatctcttttgatacaacatttaaaacaagtagcttcaagaaaccactggtgttttgaggatagtatttctaaatagcattcaggaacagagtattattgcacagatctgaagatcaaaaaaaagctcaaggaaatacagatcggaagtgctgatgagttatatttattgaaaacccaacttttaaggaagtgctaagatcagtcacccatgtgaataagaagccaggaaaggaaagatggggaagcccagatcaccaggcttctattaaggaggaaagcaacagaggaaacagtgaaggggaacagaagggggtagcaaagtgttacagaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagacttcaaaataccccttatgagaatccaaagaatgatgtgtgtaagggaagattttatttgcccttccggaagaaatcagtatctatgcaaatcttgaaagacgaaatcaaagcccattaatgattcagaatcagtgcttgacctcctgtattctgaatggtgaactctggaagcagggattgtgtctggctctttttagagctggaagtgtagtggctttcattaaatacttgctgtaaagtctttctaagaccaattattatcttagcatgtttcagtatcttctctatcataggccctaagttcattgggggaaaaaaaataagaagattcaacagaatcagcatttgaagtgtaccattggtagttgtttatgaaattaccagatattcataaatgtgacaaatgaacagcaggattatgaattatcaaaggaaaaagtatttgctgaggtgaaaaaatctgatgtttgaggaagtttttatttttatttatttgttttgttttttttttttttgaggcagactctctgtcgccaggcttctcctgcctcagcctcacgagtagctgggactacaggcatgcaccaccacgcccagctaatttttgtatttttagcagagacagggaggaagtttttatttttataaacaaaatctgatgttcagaggccccgtttcttacaataaatgttgagtcttagttaagcaggaatttatgaacacccatttcctgactttttgctttaatttagatttttctccatcctgtttctagcacaaaaatttgcctgctgtgttacaaaaataaatttatgttgtcctgtgccataaagtgatatatttaatatttttattctttggttttgaacattgtaagttcctaaaaacattttattaaacaagtagacattttgttattaaaaaaatgtgatctgtaatttctttgtgcagaatgatttgaagtattgtattcagtttacatgcattattggtttataattaatatctaatgaaaatacatgttgttatattgtaaaaaaaaaaa

SEQ ID NO: 419135 - DNA, 2572 bp, Homo sapiens
tccccagattgcagagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaaatggaataggaataaatcctgcacagactgctggaaatgtttttctaaaacatggttcagaactgcggattattcctagagatcgtgttggaagttgttaatatctgctacttggaacatacgattgcctttcagaataaatattggtattttttgttgttgtaaaattgaaatcaggcatttaacatactatgaaaacaccaggagtcaatgattaatgaaaggtgactcatctgtccctttttgttgtccatactcttcctatgaagagggaatgcgtatgaattaaggctactactgtcacagaagatcatagtctttgatgctacctcacaacacaaacaggtagttcgttgggggcaaatgaattagccaactgttaactggaagcttttgataatttttttttttagaacaatttggaacattaaaatttactgaatcgtatatattcatctgagataaaaatataaaaagaattatggaccctggatggcaatttgcttgatagcatctgatttgcagactcataatttgatttttaattaaatatataggttatgatgaagtgaatagacatatcagtgaacagttaactatattaaatttttatcatttactttttttaagattcagacctcagttatataaatttcagtttaatatcaaccaaaaaattaaaattttaatctaacccttatgtgtataaattggtgtcccataccagcttttaatggtggacctatagaatccagtacttttaatggtgggaatttacagtagaagcatcctttgctgagttatacattcctttatcaatctcttttgatacaacatttaaaacaagtagcttcaagaaaccactggtgttttgaggatagtatttctaaatagcattcaggaacagagtattattgcacagatctgaagatcaaaaaaaagctcaaggaaatacagatcggaagtgctgatgagttatatttattgaaaacccaacttttaaggaagtgctaagatcagtcacccatgtgaataagaagccaggaaaggaaagatggggaagcccagatcaccaggcttctattaaggaggaaagcaacagaggaaacagtgaaggggaacagaagggggtagcaaagtgttacagaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagacttcaaaataccccttatgagaatccaaagaatgatgtgtgtaagggaagattttatttgcccttccggaagaaatcagtatctatgcaaatcttgaaagacgaaatcaaagcccattaatgattcagaatcagtgcttgacctcctgtattctgaatggtgaactctggaagcagggattgtgtctggctctttttagagctggaagtgtagtggctttcattaaatacttgctgtaaagtctttctaagaccaattattatcttagcatgtttcagtatcttctctatcataggccctaagttcattgggggaaaaaaaataagaagattcaacagaatcagcatttgaagtgtaccattggtagttgtttatgaaattaccagatattcataaatgtgacaaatgaacagcaggattatgaattatcaaaggaaaaagtatttgctgaggtgaaaaaatctgatgtttgaggaagtttttatttttatttatttgttttgttttttttttttttgaggcagactctctgtcgccaggcttctcctgcctcagcctcacgagtagctgggactacaggcatgcaccaccacgcccagctaatttttgtatttttagcagagacagggaggaagtttttatttttataaacaaaatctgatgttcagaggccccgtttcttacaataaatgttgagtcttagttaagcaggaatttatgaacacccatttcctgactttttgctttaatttagatttttctccatcctgtttctagcacaaaaatttgcctgctgtgttacaaaaataaatttatgttgtcctgtgccataaagtgatatatttaatatttttattctttggttttgaacattgtaagttcctaaaaacattttattaaacaagtagacattttgttattaaaaaaatgtgatctgtaatttctttgtgcagaatgatttgaagtattgtattcagtttacatgcattattggtttataattaatatctaatgaaaatacatgttgttatattgtaaaaaaaaaaa

SEQ ID NO: 419136 - DNA, 2114 bp, Homo sapiens
  misc_feature (2027)..(2028): n is a, c, g, or t
  misc_feature (2037)..(2038): n is a, c, g, or t
  misc_feature (2040)..(2040): n is a, c, g, or t
  misc_feature (2068)..(2068): n is a, c, g, or t
  misc_feature (2070)..(2070): n is a, c, g, or t
  misc_feature (2088)..(2088): n is a, c, g, or t
  misc_feature (2095)..(2095): n is a, c, g, or t
  misc_feature (2099)..(2100): n is a, c, g, or t
  misc_feature (2103)..(2103): n is a, c, g, or t
  misc_feature (2105)..(2105): n is a, c, g, or t
  misc_feature (2109)..(2109): n is a, c, g, or t
tccccagattgcagagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctagagatcgtgttggaagttgttaatatctgctacttggaacatacgattgcctttcagaataaatattggtattttttgttgttgtaaaattgaaatcaggcatttaacatactatgaaaacaccaggagtcaatgattaatgaaaggtgactcatctgtccctttttgttgtccatactcttcctatgaagagggaatgcgtatgaattaaggctactactgtcacagaagatcatagtctttgatgctacctcacaacacaaacaggtagttcgttgggggcaaatgaattagccaactgttaactggaagcttttgataatttttttttttagaacaatttggaacattaaaatttactgaatcgtatatattcatctgagataaaaatataaaaagaattatggaccctggatggcaatttgcttgatagcatctgatttgcagactcataatttgatttttaattaaatatataggttatgatgaagtgaatagacatatcagtgaacagttaactatattaaatttttatcatttactttttttaagattcagacctcagttatataaatttcagtttaatatcaaccaaaaaattaaaattttaatctaacccttatgtgtataaattggtgtcccataccagcttttaatggtggacctatagaatccagtacttttaatggtgggaatttacagtagaagcatcctttgctgagttatacattcctttatcaatctcttttgatacaacatttaaaacaagtagcttcaagaaaccactggtgttttgaggatagtatttctaaatagcattcaggaacagagtattattgcacagatctgaagatcaaaaaaaagctcaaggaaatacagatcggaagtgctgatgagttatatttattgaaaacccaacttttaaggaagtgctaagatcagtcacccatgtgaataagaagccaggaaaggaaagatggggaagcccagatcaccaggcttctattaaggaggaaagcaacagaggaaacagtgaaggggaacagaagggggtagcaaagtgttacagaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagacttcaaaataccccttatgagaatccaaagaatgatgtgtgtaagggaagattttatttgcccttccggaagaaatcagtatctatgcaaatcttgaaagacgaaatcaaagcccattaatgattcagaatcagtgcttgacctcctgtattctgaatggtgaactctggaagcagggattgtgtctggctctttttagagctggaagtgtagtggctttcattaaatacttgctgtaaagtctttctaagaccaattattatcttagcatgtttcagtatcttctctatcataggccctaagttcattgggggaaaaaaaataagaagattcaacagaatcagcatttgaagtgtaccattggtagttgtttatgaaattaccagatattcataaatgtgacaaatgaacagcaggattatgaattatcaaaggaaaaagtatttgctgaggcaggagaanngcttgaacnngngaggtggaggttgcagtgagccgagatngngccattgcactccagccngggcaanagannganantccntctca

SEQ ID NO: 419137 - DNA, 2108 bp, Homo sapiens
ggcacgagggttccgctgtctcgggaaccgtcgtatccctcggtccggcggcggcggcggcggcggcggtagcggaggagacggtttcaggcctccggtgcggctgcaatgctgagctcccgggccgaggcggcgatgaccgcggccgacagggccatccagcgcttcctgcggaccggggcggccgtcagatataaagtcatgaagaactggggagttataggtggaattgctgctgctcttgcagcaggaatatatgttatttggggtcccattacagaaagaaagaagcgtagaaaagggcttgtgcctggccttgttaatttagggaacacctgcttcatgaactccctgctacaaggcctgtctgcctgtcctgctttcatcaggtggctggaagagttcacctcccagtactccagggatcagaaggagcccccctcacaccagtatttatccttaacactcttgcaccttctgaaagccttgtcctgccaagaagttactgatgatgaggtcttagatgcaagctgcttgttggatgtcttaagaatgtacagatggcagatctcatcatttgaagaacaggatgctcacgaattattccatgtcattacctcgtcattggaagatgagcgagaccgccagcctcgggtcacacatttgtttgatgtgcattccctggagcagcagtcagaaataactcccaaacaaattacctgccgcacaagagggtcacctcaccccacatccaatcactggaagtctcaacatccttttcatggaagactcactagtaatatggtctgcaaacactgtgaacaccagagtcctgttcgatttgatacctttgatagcctttcactaagtattccagccgccacatggggtcacccattgaccctggaccactgccttcaccacttcatctcatcagaatcagtgcgggatgttgtgtgtgacaactgtacaaagattgaagccaagggaacgttgaacggggaaaaggtggaacaccagaggaccacttttgttaaacagttaaaactagggaagctccctcagtgtctctgcatccacctacagcggctgagctggtccagccacggcacgcctctgaagcggcatgagcacgtgcagttcaatgagttcctgatgatggacatttacaagtaccacctccttggacataaacctagtcaacacaaccctaaactgaacaagaacccagggcctacactggagctgcaggatgggccgggagcccccacaccagttctgaatcagccaggggcccccaaaacacagatttttatgaatggcgcctgctccccatctttattgccaacgctgtcagcgccgatgcccttccctctcccagttgttcccgactacagctcctccacatacctcttccggctgatggcagttgtcgtccaccatggagacatgcactctggacactttgtcacttaccgacggtccccaccttctgccaggaaccctctctcaactagcaatcagtggctgtgggtctccgatgacactgtccgcaaggccagcctgcaggaggtcctgtcctccagcgcctacctgctgttctacgagcgcgtcctttccaggatgcagcaccagagccaggagtgcaagtctgaagaatgactgtgccctcctgcaaggctagagctgatggcactgtctgcactgtccaggaaaaaagtaaaactgtactgttgcgtgtgcaagcggccccactagagccttccagccttctggtgtgttctaagagcaggctccacctgggagccagccccagttcacaccaaaccaggctccctgaacagtcctgttcatgtgtgtaggtggttctgttgtgttaagaaagcattcattatgtccggagtgtctttttactcatctgatacaggtaattaaaagaactcagattcttgaagccaccgttttcatattgtaatgttaggtgttctcagaggggaggtacctttgtctaatcaacgtttccacttagatcttttatttttaataagcaggcccataaaaattgttgacaagaattaatgaaattattaaaggcaacaatttagaag

SEQ ID NO: 419138 - DNA, 883 bp, Homo sapiens
gatctctagcaggatccccgggagcgtctccatgtccggagtgtctttttactcatctgatacaggtaattaaaagaactcagattcttgaagccaccgttttcatattgtaatgttaggtgttctcagaggggaggtacctttgtctaatcaacgtttccacttagatcttttatttttaataagcaggcccataaaaattgttgacaagaattaatgaaattattaaaggcaacaatttagaagaaaaagtgcctttcactttcgattgcttttgtagcacgtccattgtgaaatattccttccaggctactcaaaggatagcaagagaacaggtaaatgatgcctaaagaacaccttcctttttctatgccttttctaatctttcaattctttctatggagtaaaggctcatctgccaaatctgccccctggggaaactctttcactactttgtcagttataagtgaagagcttacttgttgcttttatcttttgtatattggactgagatgtaattacactgtattataaaactctgtgaatagccagaactgagctggatctttgcaacacctgattcctctgctctgtggaaaactttttcttacacaaggatccactgtggacggttactttcatctgtttatttattgcccatgcagagctcttaaggtttacaggtgggagcttggggctgtataaaaaaataatccctgccctgagttgacacctggcttaggaaggaagggctgactatggggctgcagtctctctgaacctcagtttcctcatttgtgaagtgaagggttagatttgatgaccaccaaagttcagccttttcacgaaaaggagaaagcagcttttgactttttaaaaaaca

SEQ ID NO: 419139 - DNA, 2657 bp, Homo sapiens
gcggtcatcgccgcctcggcccgggagctcagcattgcagccgcaccggaggcctgaaaccgtctcctccgctaccgccgccgccgccgccgccgccggaccgagggatacgacggttcccgagacagcggaacctgcggcccggggcggccgtcagatataaagtcatgaagaactggggagttataggtggaattgctgctgctcttgcagcaggaatatatgttatttggggtcccattacagaaagaaagaagcgtagaaaagggcttgtgcctggccttgttaatttagggaacacctgcttcatgaactccctgctacaaggcctgtctgcctgtcctgctttcatcaggtggctggaagagttcacctcccagtactccagggatcagaaggagcccccctcacaccagtatttatccttaacactcttgcaccttctgaaagccttgtcctgccaagaagttactgatgatgaggtcttagatgcaagctgcttgttggatgtcttaagaatgtacagatggcagatctcatcatttgaagaacaggatgctcacgaattattccatgtcattacctcgtcattggaagatgagcgagaccgccagcctcgggtcacacatttgtttgatgtgcattccctggagcagcagtcagaaataactcccaaacaaattacctgccgcacaagagggtcacctcaccccacatccaatcactggaagtctcaacatccttttcatggaagactcactagtaatatggtctgcaaacactgtgaacaccagagtcctgttcgatttgatacctttgatagcctttcactaagtattccagccgccacatggggtcacccattgaccctggaccactgccttcaccacttcatctcatcagaatcagtgcgggatgttgtgtgtgacaactgtacaaagattgaagccaagggaacgttgaacggggaaaaggtggaacaccagaggaccacttttgttaaacagttaaaactagggaagctccctcagtgtctctgcatccacctacagcggctgagctggtccagccacggcacgcctctgaagcggcatgagcacgtgcagttcaatgagttcctgatgatggacatttacaagtaccacctccttggacataaacctagtcaacacaaccctaaactgaacaagaacccagggcctacactggagctgcaggatgggccgggagcccccacaccagttctgaatcagccaggggcccccaaaacacagatttttatgaatggcgcctgctccccatctttattgccaacgctgtcagcgccgatgcccttccctctcccagttgttcccgactacagctcctccacatacctcttccggctgatggcagttgtcgtccaccatggagacatgcactctggacactttgtcacttaccgacggtccccaccttctgccaggaaccctctctcaactagcaatcagtggctgtgggtctccgatgacactgtccgcaaggccagcctgcaggaggtcctgtcctccagcgcctacctgctgttctacgagcgcgtcctttccaggatgcagcaccagagccaggagtgcaagtctgaagaatgactgtgccctcctgcaaggctagagctgatggcactgtctgcactgtccaggaaaaaagtaaaactgtactgttgcgtgtgcaagcggccccactagagccttccagccttctggtgtgttctaagagcaggctccacctgggagccagccccagttcacaccaaaccaggctccctgaacagtcctgttcatgtgtgtaggtggttctgttgtgttaagaaagcattcattatgtccggagtgtctttttactcatctgatacaggtaatttcagaggggaggtacctttgtctaatcaacgtttccacttagatcttttatttttaataagcaggcccataaaaattgttgacaagaattaatgaaattattaaaggcaacaatttagaagaaaaagtgcctttcactttcgattgcttttgtagcacgtccattgtgaaatattccttccaggctactcaaaggatagcaagagaacaggtaaatgatgcctaaagaacaccttcctttttctatgccttttctaatctttcaattctttctatggagtaaaggctcatctgccaaatctgccccctggggaaactctttcactactttgtcagttataagtgaagagcttacttgttgcttttatcttttgtatattggactgagatgtaattacactgtattataaaactctgtgaatagccagaactgagctggatctttgcaacacctgattcctctgctctgtggaaaactttttcttacacaaggatccactgtggacggttactttcatctgtttatttattgcccatgcagagctcttaaggtttacaggtgggagcttggggctgtataaaaaaataatccctgccctgagttgacacctggcttaggaaggaagggctgactatggggctgcagtctctctgaacctcagtttcctcatttgtgaagtgaagggttagatttgatgaccaccaaagttcagccttttcacgaaaaggagaaagcagcttttgactttttaaaaaaca

SEQ ID NO: 419140 - DNA, 2858 bp, Homo sapiens
ggcacgagggttccgctgtctcgggaaccgtcgtatccctcggtccggcggcggcggcggcggcggcggtagcggaggagacggtttcaggcctccggtgcggctgcaatgctgagctcccgggccgaggcggcgatgaccgcggccgacagggccatccagcgcttcctgcggaccggggcggccgtcagccctatgaggtaggtcttatggattgtccccattgtacagatgaggaaactgaggcttagaaggtgaagtgatgccaaatgaaatagcaaagccaggattgaaccagaataagatataaagtcatgaagaactggggagttataggtggaattgctgctgctcttgcagcaggaatatatgttatttggggtcccattacagaaagaaagaagcgtagaaaagggcttgtgcctggccttgttaatttagggaacacctgcttcatgaactccctgctacaaggcctgtctgcctgtcctgctttcatcaggtggctggaagagttcacctcccagtactccagggatcagaaggagcccccctcacaccagtatttatccttaacactcttgcaccttctgaaagccttgtcctgccaagaagttactgatgatgaggtcttagatgcaagctgcttgttggatgtcttaagaatgtacagatggcagatctcatcatttgaagaacaggatgctcacgaattattccatgtcattacctcgtcattggaagatgagcgagaccgccagcctcgggtcacacatttgtttgatgtgcattccctggagcagcagtcagaaataactcccaaacaaattacctgccgcacaagagggtcacctcaccccacatccaatcactggaagtctcaacatccttttcatggaagactcactagtaatatggtctgcaaacactgtgaacaccagagtcctgttcgatttgatacctttgatagcctttcactaagtattccagccgccacatggggtcacccattgaccctggaccactgccttcaccacttcatctcatcagaatcagtgcgggatgttgtgtgtgacaactgtacaaagattgaagccaagggaacgttgaacggggaaaaggtggaacaccagaggaccacttttgttaaacagttaaaactagggaagctccctcagtgtctctgcatccacctacagcggctgagctggtccagccacggcacgcctctgaagcggcatgagcacgtgcagttcaatgagttcctgatgatggacatttacaagtaccacctccttggacataaacctagtcaacacaaccctaaactgaacaagaacccagggcctacactggagctgcaggatgggccgggagcccccacaccagttctgaatcagccaggggcccccaaaacacagatttttatgaatggcgcctgctccccatctttattgccaacgctgtcagcgccgatgcccttccctctcccagttgttcccgactacagctcctccacatacctcttccggctgatggcagttgtcgtccaccatggagacatgcactctggacactttgtcacttaccgacggtccccaccttctgccaggaaccctctctcaactagcaatcagtggctgtgggtctccgatgacactgtccgcaaggccagcctgcaggaggtcctgtcctccagcgcctacctgctgttctacgagcgcgtcctttccaggatgcagcaccagagccaggagtgcaagtctgaagaatgactgtgccctcctgcaaggctagagctgatggcactgtctgcactgtccaggaaaaaagtaaaactgtactgttgcgtgtgcaagcggccccactagagccttccagccttctggtgtgttctaagagcaggctccacctgggagccagccccagttcacaccaaaccaggctccctgaacagtcctgttcatgtgtgtaggtggttctgttgtgttaagaaagcattcattatgtccggagtgtctttttactcatctgatacaggtaattaaaagaactcagattcttgaagccaccgttttcatattgtaatgttaggtgttctcagaggggaggtacctttgtctaatcaacgtttccacttagatcttttatttttaataagcaggcccataaaaattgttgacaagaattaatgaaattattaaaggcaacaatttagaagaaaaagtgcctttcactttcgattgcttttgtagcacgtccattgtgaaatattccttccaggctactcaaaggatagcaagagaacaggtaaatgatgcctaaagaacaccttcctttttctatgccttttctaatctttcaattctttctatggagtaaaggctcatctgccaaatctgccccctggggaaactctttcactactttgtcagttataagtgaagagcttacttgttgcttttatcttttgtatattggactgagatgtaattacactgtattataaaactctgtgaatagccagaactgagctggatctttgcaacacctgattcctctgctctgtggaaaactttttcttacacaaggatccactgtggacggttactttcatctgtttatttattgcccatgcagagctcttaaggtttacaggtgggagcttggggctgtataaaaaaataatccctgccctgagttgacacctggcttaggaaggaagggctgactatggggctgcagtctctctgaacctcagtttcctcatttgtgaagtgaagggttagatttgatgaccaccaaagttcagccttttcacgaaaaggagaaagcagcttttgactttttaaaaaaca

SEQ ID NO: 419141 - DNA, 2424 bp, Homo sapiens
gaagaaaagagggtactcaccccacatcaatcactggaagtctcaacatccttttcatggaagactcactagtaatatggtctgcaaacactgtgaacaccagagtcctgttcgatttgatacctttgatagcctttcactaagtattccagccgccacatggccttgtcctgccaagaagttactgatgatgaggtcttagatgcaagctgcttgttggatgtcttaagaatgtacagatggcagatctcatcatttgaagaacaggatgctcacgaattattccatgtcattacctcgtcattggaagatgagcgagaccgccagcctcgggtcacacatttgtttgatgtgcattccctggagcagcagtcagaaataactcccaaacaaattacctgccgcacaagagggtcacctcaccccacatccaatcactggaagtctcaacatccttttcatggaagactcactagtaatatggtctgcaaacactgtgaacaccagagtcctgttcgatttgatacctttgatagcctttcactaagtattccagccgccacatggggtcacccattgaccctggaccactgccttcaccacttcatctcatcagaatcagtgcgggatgttgtgtgtgacaactgtacaaagattgaagccaagggaacgttgaacggggaaaaggtggaacaccagaggaccacttttgttaaacagttaaaactagggaagctccctcagtgtctctgcatccacctacagcggctgagctggtccagccacggcacgcctctgaagcggcatgagcacgtgcagttcaatgagttcctgatgatggacatttacaagtaccacctccttggacataaacctagtcaacacaaccctaaactgaacaagaacccagggcctacactggagctgcaggatgggccgggagcccccacaccagttctgaatcagccaggggcccccaaaacacagatttttatgaatggcgcctgctccccatctttattgccaacgctgtcagcgccgatgcccttccctctcccagttgttcccgactacagctcctccacatacctcttccggctgatggcagttgtcgtccaccatggagacatgcactctggacactttgtcacttaccgacggtccccaccttctgccaggaaccctctctcaactagcaatcagtggctgtgggtctccgatgacactgtccgcaaggccagcctgcaggaggtcctgtcctccagcgcctacctgctgttctacgagcgcgtcctttccaggatgcagcaccagagccaggagtgcaagtctgaagaatgactgtgccctcctgcaaggctagagctgatggcactgtctgcactgtccaggaaaaaagtaaaactgtactgttgcgtgtgcaagcggccccactagagccttccagccttctggtgtgttctaagagcaggctccacctgggagccagccccagttcacaccaaaccaggctccctgaacagtcctgttcatgtgtgtaggtggttctgttgtgttaagaaagcattcattatgtccggagtgtctttttactcatctgatacaggtaattaaaagaactcagattcttgaagccaccgttttcatattgtaatgttaggtgttctcagaggggaggtacctttgtctaatcaacgtttccacttagatcttttatttttaataagcaggcccataaaaattgttgacaagaattaatgaaattattaaaggcaacaatttagaagaaaaagtgcctttcactttcgattgcttttgtagcacgtccattgtgaaatattccttccaggctactcaaaggatagcaagagaacaggtaaatgatgcctaaagaacaccttcctttttctatgccttttctaatctttcaattctttctatggagtaaaggctcatctgccaaatctgccccctggggaaactctttcactactttgtcagttataagtgaagagcttacttgttgcttttatcttttgtatattggactgagatgtaattacactgtattataaaactctgtgaatagccagaactgagctggatctttgcaacacctgattcctctgctctgtggaaaactttttcttacacaaggatccactgtggacggttactttcatctgtttatttattgcccatgcagagctcttaaggtttacaggtgggagcttggggctgtataaaaaaataatccctgccctgagttgacacctggcttaggaaggaagggctgactatggggctgcagtctctctgaacctcagtttcctcatttgtgaagtgaagggttagatttgatgaccaccaaagttcagccttttcacgaaaaggagaaagcagcttttgactttttaaaaaaca

SEQ ID NO: 419142 - DNA, 609 bp, Homo sapiens
cagtgattgttaagataagaacagaatcattgtcctggggaagtaacaacagaacaattgttttcttctgttctgagaaacattgctttctgattaaagaagaaagagagcatgtaggggagaatgaggaagagaaaaagacaggagatggttactaagtgtttttgtacatttaggaagaaccaagctgtgctggataccatgataggtttcaaaaataacacacaaaggggacctgtccttctgtgcttacagtctgcggagcagtactagaaccaagccttggcacagatagaaggcctggccccagatctctgtggataaggatcttcttggatcgggattccaaatttaaggccacagcgcaggaactctgggtcccacatgggagagaaattgatcaaatgtgatatactgttctcttcttccccctgctttttttttagggcttgtgcctggccttgttaatttagggaacacctgcttcatgaactccctgctacaaggcctgtctgcctgtcctgctttcatcaggtggctggaagagttcacctcccagtactccagggatcagaaggagcccccctcacaccagtatttatccttaac

SEQ ID NO: 419143 - DNA, 2711 bp, Homo sapiens
gcggtcatcgccgcctcggcccgggagctcagcattgcagccgcaccggaggcctgaaaccgtctcctccgctaccgccgccgccgccgccgccgccggaccgagggatacgacggttcccgagacagcggaacctgcggcccggggcggccgtcagatataaagtcatgaagaactggggagttataggtggaattgctgctgctcttgcagcaggaatatatgttatttggggtcccattacagaaagaaagaagcgtagaaaagggcttgtgcctggccttgttaatttagggaacacctgcttcatgaactccctgctacaaggcctgtctgcctgtcctgctttcatcaggtggctggaagagttcacctcccagtactccagggatcagaaggagcccccctcacaccagtatttatccttaacactcttgcaccttctgaaagccttgtcctgccaagaagttactgatgatgaggtcttagatgcaagctgcttgttggatgtcttaagaatgtacagatggcagatctcatcatttgaagaacaggatgctcacgaattattccatgtcattacctcgtcattggaagatgagcgagaccgccagcctcgggtcacacatttgtttgatgtgcattccctggagcagcagtcagaaataactcccaaacaaattacctgccgcacaagagggtcacctcaccccacatccaatcactggaagtctcaacatccttttcatggaagactcactagtaatatggtctgcaaacactgtgaacaccagagtcctgttcgatttgatacctttgatagcctttcactaagtattccagccgccacatggggtcacccattgaccctggaccactgccttcaccacttcatctcatcagaatcagtgcgggatgttgtgtgtgacaactgtacaaagattgaagccaagggaacgttgaacggggaaaaggtggaacaccagaggaccacttttgttaaacagttaaaactagggaagctccctcagtgtctctgcatccacctacagcggctgagctggtccagccacggcacgcctctgaagcggcatgagcacgtgcagttcaatgagttcctgatgatggacatttacaagtaccacctccttggacataaacctagtcaacacaaccctaaactgaacaagaacccagggcctacactggagctgcaggatgggccgggagcccccacaccagttctgaatcagccaggggcccccaaaacacagatttttatgaatggcgcctgctccccatctttattgccaacgctgtcagcgccgatgcccttccctctcccagttgttcccgactacagctcctccacatacctcttccggctgatggcagttgtcgtccaccatggagacatgcactctggacactttgtcacttaccgacggtccccaccttctgccaggaaccctctctcaactagcaatcagtggctgtgggtctccgatgacactgtccgcaaggccagcctgcaggaggtcctgtcctccagcgcctacctgctgttctacgagcgcgtcctttccaggatgcagcaccagagccaggagtgcaagtctgaagaatgactgtgccctcctgcaaggctagagctgatggcactgtctgcactgtccaggaaaaaagtaaaactgtactgttgcgtgtgcaagcggccccactagagccttccagccttctggtgtgttctaagagcaggctccacctgggagccagccccagttcacaccaaaccaggctccctgaacagtcctgttcatgtgtgtaggtggttctgttgtgttaagaaagcattcattatgtccggagtgtctttttactcatctgatacaggtaattaaaagaactcagattcttgaagccaccgttttcatattgtaatgttaggtgttctcagaggggaggtacctttgtctaatcaacgtttccacttagatcttttatttttaataagcaggcccataaaaattgttgacaagaattaatgaaattattaaaggcaacaatttagaagaaaaagtgcctttcactttcgattgcttttgtagcacgtccattgtgaaatattccttccaggctactcaaaggatagcaagagaacaggtaaatgatgcctaaagaacaccttcctttttctatgccttttctaatctttcaattctttctatggagtaaaggctcatctgccaaatctgccccctggggaaactctttcactactttgtcagttataagtgaagagcttacttgttgcttttatcttttgtatattggactgagatgtaattacactgtattataaaactctgtgaatagccagaactgagctggatctttgcaacacctgattcctctgctctgtggaaaactttttcttacacaaggatccactgtggacggttactttcatctgtttatttattgcccatgcagagctcttaaggtttacaggtgggagcttggggctgtataaaaaaataatccctgccctgagttgacacctggcttaggaaggaagggctgactatggggctgcagtctctctgaacctcagtttcctcatttgtgaagtgaagggttagatttgatgaccaccaaagttcagccttttcacgaaaaggagaaagcagcttttgactttttaaaaaaca

SEQ ID NO: 419144 - DNA, 2452 bp, Homo sapiens
ggcacgagggttccgctgtctcgggaaccgtcgtatccctcggtccggcggcggcggcggcggcggcggtagcggaggagacggtttcaggcctccggtgcggctgcaatgctgagctcccgggccgaggcggcgatgaccgcggccgacagggccatccagcgcttcctgcggaccggggcggccgtcagccttgtcctgccaagaagttactgatgatgaggtcttagatgcaagctgcttgttggatgtcttaagaatgtacagatggcagatctcatcatttgaagaacaggatgctcacgaattattccatgtcattacctcgtcattggaagatgagcgagaccgccagcctcgggtcacacatttgtttgatgtgcattccctggagcagcagtcagaaataactcccaaacaaattacctgccgcacaagagggtcacctcaccccacatccaatcactggaagtctcaacatccttttcatggaagactcactagtaatatggtctgcaaacactgtgaacaccagagtcctgttcgatttgatacctttgatagcctttcactaagtattccagccgccacatggggtcacccattgaccctggaccactgccttcaccacttcatctcatcagaatcagtgcgggatgttgtgtgtgacaactgtacaaagattgaagccaagggaacgttgaacggggaaaaggtggaacaccagaggaccacttttgttaaacagttaaaactagggaagctccctcagtgtctctgcatccacctacagcggctgagctggtccagccacggcacgcctctgaagcggcatgagcacgtgcagttcaatgagttcctgatgatggacatttacaagtaccacctccttggacataaacctagtcaacacaaccctaaactgaacaagaacccagggcctacactggagctgcaggatgggccgggagcccccacaccagttctgaatcagccaggggcccccaaaacacagatttttatgaatggcgcctgctccccatctttattgccaacgctgtcagcgccgatgcccttccctctcccagttgttcccgactacagctcctccacatacctcttccggctgatggcagttgtcgtccaccatggagacatgcactctggacactttgtcacttaccgacggtccccaccttctgccaggaaccctctctcaactagcaatcagtggctgtgggtctccgatgacactgtccgcaaggccagcctgcaggaggtcctgtcctccagcgcctacctgctgttctacgagcgcgtcctttccaggatgcagcaccagagccaggagtgcaagtctgaagaatgactgtgccctcctgcaaggctagagctgatggcactgtctgcactgtccaggaaaaaagtaaaactgtactgttgcgtgtgcaagcggccccactagagccttccagccttctggtgtgttctaagagcaggctccacctgggagccagccccagttcacaccaaaccaggctccctgaacagtcctgttcatgtgtgtaggtggttctgttgtgttaagaaagcattcattatgtccggagtgtctttttactcatctgatacaggtaattaaaagaactcagattcttgaagccaccgttttcatattgtaatgttaggtgttctcagaggggaggtacctttgtctaatcaacgtttccacttagatcttttatttttaataagcaggcccataaaaattgttgacaagaattaatgaaattattaaaggcaacaatttagaagaaaaagtgcctttcactttcgattgcttttgtagcacgtccattgtgaaatattccttccaggctactcaaaggatagcaagagaacaggtaaatgatgcctaaagaacaccttcctttttctatgccttttctaatctttcaattctttctatggagtaaaggctcatctgccaaatctgccccctggggaaactctttcactactttgtcagttataagtgaagagcttacttgttgcttttatcttttgtatattggactgagatgtaattacactgtattataaaactctgtgaatagccagaactgagctggatctttgcaacacctgattcctctgctctgtggaaaactttttcttacacaaggatccactgtggacggttactttcatctgtttatttattgcccatgcagagctcttaaggtttacaggtgggagcttggggctgtataaaaaaataatccctgccctgagttgacacctggcttaggaaggaagggctgactatggggctgcagtctctctgaacctcagtttcctcatttgtgaagtgaagggttagatttgatgaccaccaaagttcagccttttcacgaaaaggagaaagcagcttttgactttttaaaaaaca

SEQ ID NO: 419145 - DNA, 1012 bp, Homo sapiens
ggcacgagggttccgctgtctcgggaaccgtcgtatccctcggtccggcggcggcggcggcggcggcggtagcggaggagacggtttcaggcctccggtgcggctgcaatgctgagctcccgggccgaggcggcgatgaccgcggccgacagggccatccagcgcttcctgcggaccggggcggccgtcagatataaagtcatgaagaactggggagttataggtggaattgctgctgctcttgcagcaggaatatatgttatttggggtcccattacagaaagaaagaagcgtagaaaagggcttgtgcctggccttgttaatttagggaacacctgcttcatgaactccctgctacaaggcctgtctgcctgtcctgctttcatcaggtggctggaagagttcacctcccagtactccagggatcagaaggagcccccctcacaccagtatttatccttaacactcttgcaccttctgaaagccttgtcctgccaagaagttactgatgatgaggtcttagatgcaagctgcttgttggatgtcttaagaatgtacagatggcagatctcatcatttgaagaacaggatgctcacgaattattccatgtcattacctcgtcattggaagatgagcgagaccgccagcctcgggtcacacatttgtttgatgtgcattccctggagcagcagtcagaaataactcccaaacaaattacctgccgcacaagagggtcacctcaccccacatccaatcactggaagtctcaacatccttttcatggaagactcactagtaatatggtctgcaaacactgtgaacaccagccattactgactccgggatcagtcaactttataacattttcattgccccctaaagaaactccatactcattagcaacctctccccatcctttccatcaccctacccttgtcaaccatgaatctacctctgtctctatggatttgcatattctggatgcttcatataaatggaatcatgtaatgt

SEQ ID NO: 419146 - DNA, 563 bp, Homo sapiens
tcatcaatacccatacaccatatgtaatacaaatggaggtgttacgattaaaaaaagtggaggtaactgattcttggggagcggagttcactgctgcccagtggagtcagggaggcagcgtttgtctcatcgttcttcttgcggttcacttcctttgggacaggaagtcttccctgcaaagcaggcagacccacacacagacagacacacataaaagacaaaattagtcatgcttctgaaaccattttttaaaattttgcttttcctgcccagcccacattatacccttgaactcttgctgttttgcaaaacagagtttacatattaaacacagttcacctgaatgtaaatattaggtctgtgaggaaatgaagtaattaaacactggccacctttgcttcagtagaatgaagtgcttctgttacggtggtgccagccatgtgtgaggcagcattccccagtgtcaggtttcttgggacagtttctagtatcagatagggcccaaccttagactgggtgattgatagatactcacaggagtgtcagttgataattataaaaaa

SEQ ID NO: 419147 - DNA, 1614 bp, Homo sapiens
taccttacagcttgcgtatttattgaacaaatactactaaaatagctaaaatacattgggtacttgtcatgagtgcatcagtaaagatcacactgttacaaaagcctgcattttcagcagtacacaactgcaactctacataaatgccacagatgcagaatactgttttcttgctctatttacacagctgatatacctattctaacgaaggagggagaggagtaatgcacaagaaactcaggccaatgggggagcaagaagaaaacgaagaagtgcagtgcatgcgtcatcggtgtttaacagtcagaagcgaaacagttcagaacaaggcctgccctgtcaaaagaagagctaaagacagttatataaaaattaaggtgggctttcagactggctaacacaacaacattccatgagtagatggtaatttatttttgtttatccatttcgttgggagcaaggacaaaaatgtaaatctacaccttgcttatcaaaattgccgaaaaaagaatgctctgccttttaaaaaagtatcatgattttgtagaccttgttttccaatttaatatttggaaaaggtgtcattttcatattcctactcagatgccagtgttttgggtttttttccagggggagtttatttaaaacggttttgctctttttttcgacaaatatcctttcaaacagaaagaacccaaagagacacctcaaaatgcctgtaaaattattgcttttctttctctaagtcaggcaggcgaggctacggaaaggaagagatttggtaagtaaattacagttttgtgattgctcccgctaccgtgactgcatgtccgtgagcgccagccaacgagacaatggtctctcacactctggtagcattcgctcaacctacaacactgaggaagaaagccacactgaagacacaaggaaaacaagtcaatccagtctagagaacaacattcagggaaacagagtaccaacaccttcttagaacatggaaataaaaaataactccatcagagctacctcgccaaggagcatgttgaaagtccaaaatagcaccattcatcagtgtctcaggtcctgtggcagcatctcggtcacttaccacaaggaaacaatgagtttcaaactacttctatacatcaaaagagtacatggataaaatatagagatatacagacaattgatgaacataaactactagaataactcaatctcagtgtgactactgatccgccgccacgtggcttcccggacacactgctgcagcgccaacagtggagaggagctctccatcacaaccagacagcagaagcacagcacagtgaagcacacctgcccacatgatgcacaatacaggtattcatttacaacagatagattttatgccctgtacaggtatgaacacagtgaagatttgacgatggtctctctttcagctgaactctggagttttaattactgacattttcttggaagaaattatcctttgtggttttaaaacatgtgggcttttttttttgttgctcaagtcacatgttctaacaagacagttttaataagccagtttgactagatgtaaagtacttggattaaagtgataatcttact

SEQ ID NO: 419148 - DNA, 1540 bp, Homo sapiens
taccttacagcttgcgtatttattgaacaaatactactaaaatagctaaaatacattgggtacttgtcatgagtgcatcagtaaagatcacactgttacaaaagcctgcattttcagcagtacacaactgcaactctacataaatgccacagatgcagaatactgttttcttgctctatttacacagctgatatacctattctaacgaaggagggagaggagtaatgcacaagaaactcaggccaatgggggagcaagaagaaaacgaagaagtgcagtgcatgcgtcatcggtgtttaacagtcagaagcgaaacagttcagaacaaggcctgccctgtcaaaagaagagctaaagacagttatataaaaattaaggtgggctttcagactggctaacacaacaacattccatgagtagatggtaatttatttttgtttatccatttcgttgggagcaaggacaaaaatgtaaatctacaccttgcttatcaaaattgccgaaaaaagaatgctctgccttttaaaaaagtatcatgattttgtagaccttgttttccaatttaatatttggaaaaggtgtcattttcatattcctactcagatgccagtgttttgggtttttttccagggggagtttatttaaaacggttttgctctttttttcgacaaatatcctttcaaacagaaagaacccaaagagacacctcaaaatgcctgtaaaattattgcttttctttctctaagtcaggcaggcgaggctacggaaaggaagagatttggtaagtaaattacagttttgtgattgctcccgctaccgtgactgcatgtccgtgagcgccagccaacgagacaatggtctctcacactctggtagcattcgctcaacctacaacactgaggaagaaagccacactgaagacacaaggaaaacaagtcaatccagtctagagaacaacattcagggaaacagagtaccaacaccttcttagaacatggaaataaaaaataactccatcagagctacctcgccaaggagcatgttgaaagtccaaaatagcaccattcatcagtgtctcaggtcctgtggcagcatctcggtcacttaccacaaggaaacaatgagtttcaaactacttctatacatcaaaagagtacatggataaaatatagagatatacagacaattgatgaacataaactactaggtttgttacatctaaatgaaaaaaaaggtgggggggggactctcagcctctgcaagaagcagtcgggagctgtgtgagtgaaaaggcaggagtggaccggttgtgtgagcgcggtgggagtttgagttgtggaagacattgttgtagcgaaccaggcctgaaggcccacctgtaagggttgtaaacgtggattcacagtgtgaaattctgagcgttttcacttgagtcagaatgattaaaaactggtttgatgacacctatttgtccactgtaaattctctaaagcaaggctcagagtcccatagtttcttcttatacttgatgatttacaca

SEQ ID NO: 419149 - DNA, 1385 bp, Homo sapiens
gcggcgcctactactactgctcgaattcaagcttctaacgatgtacggggacatgcgtcatcggtgtttaacagtcagaagcgaaacagttcagaacaaggcctgccctgtcaaaagaagagctaaagacagttatataaaaattaaggtgggctttcagactggctaacacaacaacattccatgagtagatggtaatttatttttgtttatccatttcgttgggagcaaggacaaaaatgtaaatctacaccttgcttatcaaaattgccgaaaaaagaatgctctgccttttaaaaaagtatcatgattttgtagaccttgttttccaatttaatatttggaaaaggtgtcattttcatattcctactcagatgccagtgttttgggtttttttccagggggagtttatttaaaacggttttgctctttttttcgacaaatatcctttcaaacagaaagaacccaaagagacacctcaaaatgcctgtaaaattattgcttttctttctctaagtcaggcaggcgaggctacggaaaggaagagatttggtaagtaaattacagttttgtgattgctcccgctaccgtgactgcatgtccgtgagcgccagccaacgagacaatggtctctcacactctggtagcattcgctcaacctacaacactgaggaagaaagccacactgaagacacaaggaaaacaagtcaatccagtctagagaacaacattcagggaaacagagtaccaacaccttcttagaacatggaaataaaaaataactccatcagagctacctcgccaaggagcatgttgaaagtccaaaatagcaccattcatcagtgtctcaggtcctgtggcagcatctcggtcacttaccacaaggaaacaatgagtttcaaactacttctatacatcaaaagagtacatggataaaatatagagatatacagacaattgatgaacataaactactagaataactcaatctcagtgtgactactgatccgccgccacgtggcttcccggacacactgctgcagcgccaacagtggagaggagctctccatcacaaccagacagcagaagcacagcacagtgaagcacacctgcccacatgatgcacaatacaggtattcatttacaacagatagattttatgccctgtacaggtatgaacacagtgaagatttgacgatggtctctctttcagctgaactctggagttttaattactgacattttcttggaagaaattatcctttgtggttttaaaacatgtgggcttttttttttgttgctcaagtcacatgttctaacaagacagttttaataagccagtttgactagatgtaaagtacttggattaaagtgataatcttact

SEQ ID NO: 419150 - DNA, 894 bp, Homo sapiens
ggccccacttccgggttgggccgtgggctggggagtcgtggaggcgcggtcctggtccccacccggcgcgctgggactcgcccgcctcccgtctgtcaccccctgcgcctcgccgggacaacggggtgagggcatgggggcgtggggccccagcctatgttccccgcggcactggcgcggcggccgcgccgaccgaagtccgggacgggggaggggcccgagcgccagcggccgggcgggagtctcaggagcgggttcccggtccctgcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaacccgaaagccaataacctctgatactgggtctcgaactttggagcgcacaggtcttggacctcctggtgtttaaccgtg

SEQ ID NO: 419151 - DNA, 266 bp, Homo sapiens
aagggctgaaggggtggtcgtgtgccccatggagaccatcaaggtgaagttcaggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgca

SEQ ID NO: 419152 - DNA, 2178 bp, Homo sapiens
cccagacaagctgcctaggagaatacagccgcttgcatttgtggtctttcctgaccttgttcgctgagcgcagaaactacaaccgggaaaggtgtgggtgggaaccggcaggtgaggcccggcccgtggctgctgcgggaggggggcccggcggcgtagccccttctcaccggcctcccgcctcccgcctccaggtttgaaacgttagagttcctctgggactgggctagccccacgtgttttcggggagggtgtgcccctggcctccgggatccctggggatcccgccgctctcgacagtcgcgcagacccgaggcccgctatcccgcggcgcggcacacagtgcaccttgacccactgctcggagctgggccacggctccgcctcccgcagccccgcccccgtcccgccgctcgcggtcgcccagggactcggcctcggccattggctgcgctttggccccgcccctacgcctgcctcggcgcgccccgcccaggcctcagtttcccggcccgcacggggcgggctgggggcggggcctggctcggaccacgcggggcgggacctggagctgacgcggccgccccgcccctgggaccataaccggccgccgccgccaccgcggaccgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgca

SEQ ID NO: 419153 - DNA, 2202 bp, Homo sapiens
cccagacaagctgcctaggagaatacagccgcttgcatttgtggtctttcctgaccttgttcgctgagcgcagaaactacaaccgggaaaggtgtgggtgggaaccggcaggtgaggcccggcccgtggctgctgcgggaggggggcccggcggcgtagccccttctcaccggcctcccgcctcccgcctccaggtttgaaacgttagagttcctctgggactgggctagccccacgtgttttcggggagggtgtgcccctggcctccgggatccctggggatcccgccgctctcgacagtcgcgcagacccgaggcccgctatcccgcggcgcggcacacagtgcaccttgacccactgctcggagctgggccacggctccgcctcccgcagccccgcccccgtcccgccgctcgcggtcgcccagggactcggcctcggccattggctgcgctttggccccgcccctacgcctgcctcggcgcgccccgcccaggcctcagtttcccggcccgcacggggcgggctgggggcggggcctggctcggaccacgcggggcgggacctggagctgacgcggccgccccgcccctgggaccataaccggccgccgccgccaccgcggaccgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgcacttgtccatgtgcttactgtgatgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgca

SEQ ID NO: 419154 - DNA, 1664 bp, Homo sapiens
ggccccacttccgggttgggccgtgggctggggagtcgtggaggcgcggtcctggtccccacccggcgcgctgggactcgcccgcctcccgtctgtcaccccctgcgcctcgccgggacaacggggtgagggcatgggggcgtggggccccagcctatgttccccgcggcactggcgcggcggccgcgccgaccgaagtccgggacgggggaggggcccgagcgccagcggccgggcgggagtctcaggagcgggttcccggtccctgcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgca

SEQ ID NO: 419155 - DNA, 2261 bp, Homo sapiens
cccagacaagctgcctaggagaatacagccgcttgcatttgtggtctttcctgaccttgttcgctgagcgcagaaactacaaccgggaaaggtgtgggtgggaaccggcaggtgaggcccggcccgtggctgctgcgggaggggggcccggcggcgtagccccttctcaccggcctcccgcctcccgcctccaggtttgaaacgttagagttcctctgggactgggctagccccacgtgttttcggggagggtgtgcccctggcctccgggatccctggggatcccgccgctctcgacagtcgcgcagacccgaggcccgctatcccgcggcgcggcacacagtgcaccttgacccactgctcggagctgggccacggctccgcctcccgcagccccgcccccgtcccgccgctcgcggtcgcccagggactcggcctcggccattggctgcgctttggccccgcccctacgcctgcctcggcgcgccccgcccaggcctcagtttcccggcccgcacggggcgggctgggggcggggcctggctcggaccacgcggggcgggacctggagctgacgcggccgccccgcccctgggaccataaccggccgccgccgccaccgcggaccgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcaggtggtggggccgggaaggggaggggaaggggggaccaggccagagctagctgctgagcccctgcctgctgatgtcccccatagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgca

SEQ ID NO: 419156 - DNA, 2039 bp, Homo sapiens
cccagacaagctgcctaggagaatacagccgcttgcatttgtggtctttcctgaccttgttcgctgagcgcagaaactacaaccgggaaaggtgtgggtgggaaccggcaggtgaggcccggcccgtggctgctgcgggaggggggcccggcggcgtagccccttctcaccggcctcccgcctcccgcctccaggtttgaaacgttagagttcctctgggactgggctagccccacgtgttttcggggagggtgtgcccctggcctccgggatccctggggatcccgccgctctcgacagtcgcgcagacccgaggcccgctatcccgcggcgcggcacacagtgcaccttgacccactgctcggagctgggccacggctccgcctcccgcagccccgcccccgtcccgccgctcgcggtcgcccagggactcggcctcggccattggctgcgctttggccccgcccctacgcctgcctcggcgcgccccgcccaggcctcagtttcccggcccgcacggggcgggctgggggcggggcctggctcggaccacgcggggcgggacctggagctgacgcggccgccccgcccctgggaccataaccggccgccgccgccaccgcggaccgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgca

SEQ ID NO: 419157 - DNA, 1543 bp, Homo sapiens
gctaaaggcagccttaaagtctttaaaaaatacttttataaagcagaaaacaaaatgacaccttcactgccaaaactggaaaagagcagcaaacataaagggagaggctgctcacagggctgccctgtgtcccagagcatggtccgtgtgggctgccctgtgtcccggggcatggtccgtgtgggcagcccagggcggccttggctgcactgcttcctggggaagagttcccagttccctccaccctggatgggccctgggcctgccagctagccaggacccacccaggtggcagccgagaacctgcgcctttgcttctctctctcaggtgaagttcatccacgaccagacctccccaaaccccaagtacagaggattcttccacggggttagggagattgtgcgggaacaaggtgagccactcgaccttcctgatagggctcagggacctgggccagggtgggaagggcctgcacctcccatcctgccttgggctttgtgcaacacccaccccccacacacaccaattcccaaccggggcctgagaggctgcagggtaaccccgtgcctgccttcccgcagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgca

SEQ ID NO: 419158 - DNA, 733 bp, Homo sapiens
cttcatcatagatgacaaacactatggccacatccaggcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgca

SEQ ID NO: 419159 - DNA, 824 bp, Homo sapiens
  misc_feature (687)..(687): n is a, c, g, or t
  misc_feature (699)..(699): n is a, c, g, or t
  misc_feature (701)..(701): n is a, c, g, or t
  misc_feature (706)..(706): n is a, c, g, or t
  misc_feature (712)..(713): n is a, c, g, or t
ggccccacttccgggttgggccgtgggctggggagtcgtggaggcgcggtcctggtccccacccggcgcgctgggactcgcccgcctcccgtctgtcaccccctgcgcctcgccgggacaacggggtgagggcatgggggcgtggggccccagcctatgttccccgcggcactggcgcggcggccgcgccgaccgaagtccgggacgggggaggggcccgagcgccagcggccgggcgggagtctcaggagcgggttcccggtccctgcaggcggcctggcgggtggcatcgagatctgcatcaccttccccaccgagtacgtgaagacgcagctgcagctggacgagcgctcgcacccgccgcggtaccggggcatcggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcaggncgcggcgccaantnccggnacacgnnggactgggctgacattctgagaaaggggggccaaatctcaagggctgtccccgctgggcgggttgcccggttggcaagagttgccactatagacggggggctccacacggg

SEQ ID NO: 419160 - DNA, 2369 bp, Homo sapiens
cccagacaagctgcctaggagaatacagccgcttgcatttgtggtctttcctgaccttgttcgctgagcgcagaaactacaaccgggaaaggtgtgggtgggaaccggcaggtgaggcccggcccgtggctgctgcgggaggggggcccggcggcgtagccccttctcaccggcctcccgcctcccgcctccaggtttgaaacgttagagttcctctgggactgggctagccccacgtgttttcggggagggtgtgcccctggcctccgggatccctggggatcccgccgctctcgacagtcgcgcagacccgaggcccgctatcccgcggcgcggcacacagtgcaccttgacccactgctcggagctgggccacggctccgcctcccgcagccccgcccccgtcccgccgctcgcggtcgcccagggactcggcctcggccattggctgcgctttggccccgcccctacgcctgcctcggcgcgccccgcccaggcctcagtttcccggcccgcacggggcgggctgggggcggggcctggctcggaccacgcggggcgggacctggagctgacgcggccgccccgcccctgggaccataaccggccgccgccgccaccgcggaccgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgcaaaaaaaaaaaaaaaaaaaaaaaaaaaaaaaaaaaaaaaaaaaacacaaaaacaaaaaaacaaaaaaagaaaacaaagaaaacaaaaaacacacagaaaaaaaaaacagacaagaacaacaacaacaaaaaaaaaagaaagagaggggggcaacagaaaaatatcaccggagaggacgccataaaaggacac

SEQ ID NO: 419161 - DNA, 1518 bp, Homo sapiens
ggccccacttccgggttgggccgtgggctggggagtcgtggaggcgcggtcctggtccccacccggcgcgctgggactcgcccgcctcccgtctgtcaccccctgcgcctcgccgggacaacggggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgca

SEQ ID NO: 419162 - DNA, 2315 bp, Homo sapiens
cccagacaagctgcctaggagaatacagccgcttgcatttgtggtctttcctgaccttgttcgctgagcgcagaaactacaaccgggaaaggtgtgggtgggaaccggcaggtgaggcccggcccgtggctgctgcgggaggggggcccggcggcgtagccccttctcaccggcctcccgcctcccgcctccaggtttgaaacgttagagttcctctgggactgggctagccccacgtgttttcggggagggtgtgcccctggcctccgggatccctggggatcccgccgctctcgacagtcgcgcagacccgaggcccgctatcccgcggcgcggcacacagtgcaccttgacccactgctcggagctgggccacggctccgcctcccgcagccccgcccccgtcccgccgctcgcggtcgcccagggactcggcctcggccattggctgcgctttggccccgcccctacgcctgcctcggcgcgccccgcccaggcctcagtttcccggcccgcacggggcgggctgggggcggggcctggctcggaccacgcggggcgggacctggagctgacgcggccgccccgcccctgggaccataaccggccgccgccgccaccgcggaccgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgcaaaaaaaaaaaaaaaaaaaaaaaaaaaaaaaaaaaaaaaaaaaacacaaaaacaaaaaaacaaaaaaagaaaacaaagaaaacaaaaaacacacagaaaaaaaaaacagacaagaacaacaacaacaaaaaaaaaagaaagagaggggggcaacagaaaaatatcaccggagaggacgccataaaaggacac

SEQ ID NO: 419163 - DNA, 2354 bp, Homo sapiens
cccagacaagctgcctaggagaatacagccgcttgcatttgtggtctttcctgaccttgttcgctgagcgcagaaactacaaccgggaaaggtgtgggtgggaaccggcaggtgaggcccggcccgtggctgctgcgggaggggggcccggcggcgtagccccttctcaccggcctcccgcctcccgcctccaggtttgaaacgttagagttcctctgggactgggctagccccacgtgttttcggggagggtgtgcccctggcctccgggatccctggggatcccgccgctctcgacagtcgcgcagacccgaggcccgctatcccgcggcgcggcacacagtgcaccttgacccactgctcggagctgggccacggctccgcctcccgcagccccgcccccgtcccgccgctcgcggtcgcccagggactcggcctcggccattggctgcgctttggccccgcccctacgcctgcctcggcgcgccccgcccaggcctcagtttcccggcccgcacggggcgggctgggggcggggcctggctcggaccacgcggggcgggacctggagctgacgcggccgccccgcccctgggaccataaccggccgccgccgccaccgcggaccgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcgtgagtgggggaggggcagggctattgtccccacctcaaacctttcccggcctacctggcctgcccactctgtccccttcaggcctctgtgcctctcacttcagtatctggggattgccctgtgcagggacactgtgctgacctgccttcctctccccgcccctcctcccacccagattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgca

SEQ ID NO: 419164 - DNA, 2269 bp, Homo sapiens
cccagacaagctgcctaggagaatacagccgcttgcatttgtggtctttcctgaccttgttcgctgagcgcagaaactacaaccgggaaaggtgtgggtgggaaccggcaggtgaggcccggcccgtggctgctgcgggaggggggcccggcggcgtagccccttctcaccggcctcccgcctcccgcctccaggtttgaaacgttagagttcctctgggactgggctagccccacgtgttttcggggagggtgtgcccctggcctccgggatccctggggatcccgccgctctcgacagtcgcgcagacccgaggcccgctatcccgcggcgcggcacacagtgcaccttgacccactgctcggagctgggccacggctccgcctcccgcagccccgcccccgtcccgccgctcgcggtcgcccagggactcggcctcggccattggctgcgctttggccccgcccctacgcctgcctcggcgcgccccgcccaggcctcagtttcccggcccgcacggggcgggctgggggcggggcctggctcggaccacgcggggcgggacctggagctgacgcggccgccccgcccctgggaccataaccggccgccgccgccaccgcggaccgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggtgaggagggggaggccgcggcgccgcggggggcgggtacccagggcggcggcaccgagggccgtggggtcctgaccgccccctcccccaggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgca

SEQ ID NO: 419165 - DNA, 2425 bp, Homo sapiens
gggagctgtcccggtgccgacccgcgagcttcccggcgtgctccgcgccctcccgcaactacttccggggcgggtgccgggggcggtgccccggcgagggagcgtggcggcgagctgtttgggggggttggcgacggcagcccgagggcggcgcaaggcctgaggcccagcacaggccaggtgcagtggctcacgcctatatttccaggactttgagaggctgaggcgggcggatcacctgagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcgcaaggtgcagagctagaaatgaaagacatccagggctggacagccctcttccactgtaccagcgccgggcaccagcacatggtcaggttcctcttggacagtggagccaatgccaacgtgagggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcactgcaactgacagggaaggctttctcgctgagtccagcccccagactcagagggccccctactcaggaccccaggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaagagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctgactccaagggctggcaagcgtccctgcaggccatgagcctccccgagctctcgggagccctggaggaccgtgtccgtgagatggggcaagcactgtgcttagtgacccagagcctggagaagctgcaggtgctgaacgggaagaagtggcgggagacctagcctgcgggccgaatctgacgttgggtgattggtccaccctgaagctgtgtgccagggagtgaggaggacagtgagcaggcagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagctaaaaaaaaaaaa

SEQ ID NO: 419166 - DNA, 2063 bp, Homo sapiens
gggagctgtcccggtgccgacccgcgagcttcccggcgtgctccgcgccctcccgcaactacttccggggcgggtgccgggggcggtgccccggcgagggagcgtggcggcgagctgtttgggggggttggcgacggcagcccgagggcggcgcaaggcctgaggcccagcacagggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcactgcaactgacagggaaggctttctcgctgagtccagcccccagactcagagggccccctactcaggaccccaggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaagagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctgactccaagggctggcaagcgtccctgcaggccatgagcctccccgagctctcgggagccctggaggaccgtgtccgtgagatggggcaagcactgtgcttagtgacccagagcctggagaagctgcaggtgctgaacgggaagaagtggcgggagacctagcctgcgggccgaatctgacgttgggtgattggtccaccctgaagctgtgtgccagggagtgaggaggacagtgagcaggcagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagctaaaaaaaaaaaa

SEQ ID NO: 419167 - DNA, 2434 bp, Homo sapiens
gggagctgtcccggtgccgacccgcgagcttcccggcgtgctccgcgccctcccgcaactacttccggggcgggtgccgggggcggtgccccggcgagggagcgtggcggcgagctgtttgggggggttggcgacggcagcccgagggcggcgcaaggcctgaggcccagcacagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcggagagagttagatttgaataagaagaatggtggtggctggaccccgctgatgtatgcctcctacattggccacgacacaatcgtgcacctgctgcttgaggcgggggtgagtgtgaatgtgccgaccccagaagggcagactccactgatgctggcctccagctgtggcaacgagagcatcgcctactttcttctccagggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcactgcaactgacagggaaggctttctcgctgagtccagcccccagactcagagggccccctactcaggaccccaggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaagagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctgactccaagggctggcaagcgtccctgcaggccatgagcctccccgagctctcgggagccctggaggaccgtgtccgtgagatggggcaagcactgtgcttagtgacccagagcctggagaagctgcaggtgctgaacgggaagaagtggcgggagacctagcctgcgggccgaatctgacgttgggtgattggtccaccctgaagctgtgtgccagggagtgaggaggacagtgagcaggcagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagctaaaaaaaaaaaa

SEQ ID NO: 419168 - DNA, 2153 bp, Homo sapiens
gggagctgtcccggtgccgacccgcgagcttcccggcgtgctccgcgccctcccgcaactacttccggggcgggtgccgggggcggtgccccggcgagggagcgtggcggcgagctgtttgggggggttggcgacggcagcccgagggcggcgcaaggcctgaggcccagcacagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcgggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcactgcaactgacagggaaggctttctcgctgagtccagcccccagactcagagggccccctactcaggaccccaggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaagagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctgactccaagggctggcaagcgtccctgcaggccatgagcctccccgagctctcgggagccctggaggaccgtgtccgtgagatggggcaagcactgtgcttagtgacccagagcctggagaagctgcaggtgctgaacgggaagaagtggcgggagacctagcctgcgggccgaatctgacgttgggtgattggtccaccctgaagctgtgtgccagggagtgaggaggacagtgagcaggcagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagctaaaaaaaaaaaa

SEQ ID NO: 419169 - DNA, 807 bp, Homo sapiens
tttagttttagaaaactgaactgccatgtgccaaataagggtaaccccaattcataaaaagtaaaaatcatattatcatcacatacaaagaaggcttatcttcctggtcttgatagcaagggagtttgaaggaagttcatcaaaggggtaaaatctttaagatacaaagttaaaaagaaagaagatatctcccgattatgtttttttaaaatcttcaagaaacctaagaaatacccaatagaaaaatggaggctgggcacggtggctcacacttgtaattcaagcactttgggagccctggaggaccgtgtccgtgagatggggcaagcactgtgcttagtgacccagagcctggagaagctgcaggtgctgaacgggaagaagtggcgggagacctagcctgcgggccgaatctgacgttgggtgattggtccaccctgaagctgtgtgccagggagtgaggaggacagtgagcaggcagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagctaaaaaaaaaaaa

SEQ ID NO: 419170 - DNA, 2247 bp, Homo sapiens
gggagctgtcccggtgccgacccgcgagcttcccggcgtgctccgcgccctcccgcaactacttccggggcgggtgccgggggcggtgccccggcgagggagcgtggcggcgagctgtttgggggggttggcgacggcagcccgagggcggcgcaaggcctgaggcccagcacagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcgcaaggtgcagagctagaaatgaaagacatccagggctggacagccctcttccactgtaccagcgccgggcaccagcacatggtcaggttcctcttggacagtggagccaatgccaacgtgagggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcactgcaactgacagggaaggctttctcgctgagtccagcccccagactcagagggccccctactcaggaccccaggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaagagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctggtaagagcagtggcctgactccgcactgggcagaggggaaggtgggggagccctgaagccaggtttgacccagtgggcttggctggttctccggccggcagccactctcccaggtccctgtgtgcacatgatcccagagtccaaggaaaagagggggccctggggacccaagcccacttcctcacctgtgacaggaaaactgcctatcccccaggggtaggaggtactcgagaaaggccctgtgcttggctggctgtgctgtgctgagaccgccagtgacttctgtagcctccagccaggggcccagacccgggtccccaccggcagagttttgccttcttttcgggctgacccgggcctcgtagtgtttgctcagcctgtgggaggaagggcacaacagggcttccctgcctcggccttgggaggttgcttagacactgtcaggcgggtagggaggtt

SEQ ID NO: 419171 - DNA, 919 bp, Homo sapiens
gggagctgtcccggtgccgacccgcgagcttcccggcgtgctccgcgccctcccgcaactacttccggggcgggtgccgggggcggtgccccggcgagggagcgtggcggcgagctgtttgggggggttggcgacggcagcccgagggcggcgcaaggcctgaggcccagcacaggccaggtgcagtggctcacgcctatatttccaggactttgagaggctgaggcgggcggatcacctgagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcgcaaggtgcagagctagaaatgaaagacatccagggctggacagccctcttccactgtaccagcgccgggcaccagcacatggtcaggttcctcttggacagtggagccaatgccaacgtgaggtgattgccacatctttagtggccacaggagtggcctaggtgtcatctgactctaaggagggtggctctggaggcagctaaccagagtttagggccaccctgcttcggcacgagaggctcaagatgaggggtaggaccagagtccttccaggcacaggccttttcgtacatctgtgagatgcatctcttcaagccctctcagcttccttttctttatctgaaacccacctgggtcatacagttgtaagaattacatgttttattgtatgccaggggcctaacatactgaatggcatttaaatgtcatacattacatgcaaattccttccattttcttgctttttgtatggatgaggtgaggtgatgctttgaaacagtcatg

SEQ ID NO: 419172 - DNA, 374 bp, Homo sapiens
agggctggcaagcgtccctgcaggccatgagcctccccgagctctcgggagccctggaggaccgtgtccgtgagatgggtgagtctccggggaccagacgactgagcgctccttttgtttccgagggaggcaaagggacccctttccagggaaagcgggtttgtgtctctctaccccaaggctgacctcggggctggggccataacgggtgaggggcaggtcacatcctgcagctgagaccccggggcagcaccacccagccctcctgagcctgggcgggagaggctcaaggtcatcattcctcagggcaagcactgtgcttagtgacccagagcctggagaagctgcaggtgctgaacgggaagaagtggcgg

SEQ ID NO: 419173 - DNA, 233 bp, Homo sapiens
cgtgtgtgctcgtgtaatcacttctgattcttgcagcatggccgcctggagggcgcccgccccacgcagaggagatgaggccgtaacgcacgttctgtgttctcttgaagcaaggtgcagagctagaaatgaaagacatccagggctggacagccctcttccactgtaccagcgccgggcaccagcacatggtcaggttcctcttggacagtggagccaatgccaacgtgagg

SEQ ID NO: 419174 - DNA, 2357 bp, Homo sapiens
gggagctgtcccggtgccgacccgcgagcttcccggcgtgctccgcgccctcccgcaactacttccggggcgggtgccgggggcggtgccccggcgagggagcgtggcggcgagctgtttgggggggttggcgacggcagcccgagggcggcgcaaggcctgaggcccagcacagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcgcaaggtgcagagctagaaatgaaagacatccagggctggacagccctcttccactgtaccagcgccgggcaccagcacatggtcaggttcctcttggacagtggagccaatgccaacgtgagggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcactgcaactgacagggaaggctttctcgctgagtccagcccccagactcagagggccccctactcaggaccccaggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaagagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctgactccaagggctggcaagcgtccctgcaggccatgagcctccccgagctctcgggagccctggaggaccgtgtccgtgagatggggcaagcactgtgcttagtgacccagagcctggagaagctgcaggtgctgaacgggaagaagtggcgggagacctagcctgcgggccgaatctgacgttgggtgattggtccaccctgaagctgtgtgccagggagtgaggaggacagtgagcaggcagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagctaaaaaaaaaaaa

SEQ ID NO: 419175 - DNA, 2556 bp, Homo sapiens
gggagctgtcccggtgccgacccgcgagcttcccggcgtgctccgcgccctcccgcaactacttccggggcgggtgccgggggcggtgccccggcgagggagcgtggcggcgagctgtttgggggggttggcgacggcagcccgagggcggcgcaaggcctgaggcccagcacagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcggagagagttagatttgaataagaagaatggtggtggctggaccccgctgatgtatgcctcctacattggccacgacacaatcgtgcacctgctgcttgaggcgggggtgagtgtgaatgtgccgaccccagaagggcagactccactgatgctggcctccagctgtggcaacgagagcatcgcctactttcttctccagcaaggtgcagagctagaaatgaaagacatccagggctggacagccctcttccactgtaccagcgccgggcaccagcacatggtcaggttcctcttggacagtggagccaatgccaacgtgagggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcactgcaactgacagggaaggctttctcgctgagtccagcccccagactcagagggccccctactcaggaccccaggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaagagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctgactccaagggctggcaagcgtccctgcaggccatgagcctccccgagctctcgggagccctggaggaccgtgtccgtgagatggggcaagcactgtgcttagtgacccagagcctggagaagctgcaggtgctgaacgggaagaagtggcgggagacctagcctgcgggccgaatctgacgttgggtgattggtccaccctgaagctgtgtgccagggagtgaggaggacagtgagcaggcagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagctaaaaaaaaaaaa

SEQ ID NO: 419176 - DNA, 1346 bp, Homo sapiens
gaggaggaggccagtttctggtgatgaacatacattgtccccacgtggccgaccatagtgtgaggactcacctgcctgcaacatcctgccctgcctgagccaccagagtaggaggggacagcctgggcgccacacacaaggcactgtcttggttctgagcctggggaagtggtggggctccgagtggaggaaaacgtctctgcttcgtcgtcagccactacctcccccaacctgtcccctgtgcctgccaggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaagagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctgactccaagggctggcaagcgtccctgcaggccatgagcctccccgagctctcgggagccctggaggaccgtgtccgtgagatggggcaagcactgtgcttagtgacccagagcctggagaagctgcaggtgctgaacgggaagaagtggcgggagacctagcctgcgggccgaatctgacgttgggtgattggtccaccctgaagctgtgtgccagggagtgaggaggacagtgagcaggcagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagctaaaaaaaaaaaa

SEQ ID NO: 419177 - DNA, 1154 bp, Homo sapiens
ggccgctttcccctctccggagtgacctaacacaggataacgaaacctgcactgctccgagcgcttcctccccggcccgtcgcgtctgcgaggcgaggccgggaggcgagggctctgcgcacgcgcggcgcaggcgcactgggcgccggtgctgttgccttcaggtgaccacggattcgccatcgtgagttccaggattttcaaaatggctgcagctcctcaagcaccggggcggggatctctccgtaagacgagacctctggttgtgaagacgtcgttgaacaacccatacatcatccgctggagcgctctggagagcgaggatatgcacttcatcctacagacgcttgaggacaggcttaaagctattggacttcagaagattgaagataagaagaaaaagaacaaaacaccttttctgaaaaaagaaagcagagagaaatgcagcattgctgttgatattagtgagaatctgaaggagaagaaaacagatgctaagcagcaagtgtcagggtggacgcctgcacacgtcaggaagcagcttgccattggcgttaacgaagttaccagagccctggaaaggagggaactgctgttagttctggtgtgtaaatcagtcaagcctgccatgatcacctcacacttgattcagttaagcctaagcagaagtgtccctgcctgtcaggtcccccggctcagtgagagaatcgcccccgtcattggcttaaaatgtgttctagccttggcgttcaaaaagaacaccactgactttgtggacgaagtaagagccatcatccccagagtccccagtttaagtgtaccatggcttcaagacagaattgaagattctggggaaaatttagagactgaacctctggaaagccaagacagagagcttttggacacttcatttgaagatctgtcaaaacctaagagaaagcttgctgacggtcggcaggcttctgtaacattacaaccccttaaaataaagaaactgattccaaaccctaataagataaggaaaccacccaaaagtaaaaaagctactccaaagtaatcttgcataaacttgtcatgtcatacagtttgtgaaaggacaccttgtaaagaagccttgaaactaataaaatgagttatacttacatagaaaaaaa

SEQ ID NO: 419178 - DNA, 356 bp, Homo sapiens
ggccgctttcccctctccggagtgacctaacacaggataacgaaacctgcactgctccgagcgcttcctccccggcccgtcgcgtctgcgaggcgaggccgggaggcgagggctctgcgcacgcgcggcgcaggcgcactgggcgccggtgctgttgccttcaggtgaccacggattcgccatcgtgagttccagggtttttaccttaaataactaattactggccatatttgggaagtgttgaaaaaaagcagacaatctgaggatgatgttgacttggggatccaaaggcacaggtgacaacatcaaaactacctgcaagtctcacttcatggaacacaacagaaactctgcat

SEQ ID NO: 419179 - DNA, 1634 bp, Homo sapiens
ggccgctttcccctctccggagtgacctaacacaggataacgaaacctgcactgctccgagcgcttcctccccggcccgtcgcgtctgcgaggcgaggccgggaggcgagggctctgcgcacgcgcggcgcaggcgcactgggcgccggtgctgttgccttcaggtgaccacggattcgccatcgtgagttccagccaggtgggcgcgcggggcccacgtagggcaggaggccagccccggggggatcgggcccgggactctgcggaatctggaggccgaagcccgcgcgcacgcagggtctctgctgcttccccaacgcctgttgcgtggccgcaggacccgccgccctcccggttgggccgcccagtcccgggccgggcgcgtgcacccagagcttccgcgtttctagtccggctcctctgctggattgcagcgccggctgggcaccaggagtacaaagcgaaaacccccgccggcccttctgttctccacggtctccaaggagacacggacaacagaacaacacttccgtgtgctaaatagtaaagcaccaagacagggtcagatgtgttactgggctggagtgtggtggcacaatcacgctcactgcatccttgacctcctgggctcaagtgatcttcccacctcagcctcccaagtagctgggactacaggattttcaaaatggctgcagctcctcaagcaccggggcggggatctctccgtaagacgagacctctggttgtgaagacgtcgttgaacaacccatacatcatccgctggagcgctctggagagcgaggatatgcacttcatcctacagacgcttgaggacaggcttaaagctattggacttcagaagattgaagataagaagaaaaagaacaaaacaccttttctgaaaaaagaaagcagagagaaatgcagcattgctgttgatattagtgagaatctgaaggagaagaaaacagatgctaagcagcaagtgtcagggtggacgcctgcacacgtcaggaagcagcttgccattggcgttaacgaagttaccagagccctggaaaggagggaactgctgttagttctggtgtgtaaatcagtcaagcctgccatgatcacctcacacttgattcagttaagcctaagcagaagtgtccctgcctgtcaggtcccccggctcagtgagagaatcgcccccgtcattggcttaaaatgtgttctagccttggcgttcaaaaagaacaccactgactttgtggacgaagtaagagccatcatccccagagtccccagtttaagtgtaccatggcttcaagacagaattgaagattctggggaaaatttagagactgaacctctggaaagccaagacagagagcttttggacacttcatttgaagatctgtcaaaacctaagagaaagcttgctgacggtcggcaggcttctgtaacattacaaccccttaaaataaagaaactgattccaaaccctaataagataaggaaaccacccaaaagtaaaaaagctactccaaagtaatcttgcataaacttgtcatgtcatacagtttgtgaaaggacaccttgtaaagaagccttgaaactaataaaatgagttatacttacatagaaaaaaa

SEQ ID NO: 419180 - DNA, 834 bp, Homo sapiens
ggccgctttcccctctccggagtgacctaacacaggataacgaaacctgcactgctccgagcgcttcctccccggcccgtcgcgtctgcgaggcgaggccgggaggcgagggctctgcgcacgcgcggcgcaggcgcactgggcgccggtgctgttgccttcaggtgaccacggattcgccatcgtgagttccagacagggtcagatgtgttactgggctggagtgtggtggcacaatcacgctcactgcatccttgacctcctgggctcaagtgatcttcccacctcagcctcccaagtagctgggactacaggattttcaaaatggctgcagctcctcaagcaccggggcggggatctctccgtaagacgagacctctggttgtgaagacgtcgttgaacaacccatacatcatccgctggagcgctctggagagcgaggatatgcacttcatcctacagacgcttgaggacaggcttaaagctattggacttcagaagattgaagataagaagaaaaagaacaaaacaccttttctgaaaaaagaaagcagagagaaatgcagcattgctgttgatattagtgagaatctgaaggagaagaaaacagatgctaagcagcaagtgtcagggtggacgcctgcacacgtcaggaagcagcttgccattggcgttaacgaagttaccagagccctggaaaggagggaactgctgttagttctggttctcactctgttgcccaggctggagtgcagtggtgtgatcccggctcactgcaaccccgcctcctgggttcaagcgattctcctgcctcagcctcctgaatagctggga

SEQ ID NO: 419181 - DNA, 1038 bp, Homo sapiens
cccttcttctgctctctataattatttatctcagcagcctggtgacagctaccagtaagagtacggcagccgtatttctggctggaagattcagaatatccattctatttcaccagggcagggccccaggaccaattttctgcccaggctgaatggccggaacagacacattgctgggtttctacagtgccatttcctaaatctcattttggcagacaccctggctttgatttcaggtcattttagacctgtgtggttctgctggcagccacccatcctgctaaaataactacagcttaagcacagagaggactaacaaaattaaaaatggaaataaaataaaaccaccccgcttcagtggctcacggtcaaattagcaagcaagagaagtcacaagaaaaaatacttgatgcttgtgaaagatgaagcaccgggaacagatgtgctctcctattttcactccgctgtggacacgagtcttacaaataatgcatttcctatagggcagtgatcagagagatgatgaagaatttgggacaaaaattaagtggtgtatgccaccacgaacacgcttcaggaaactgcaaaggagctgctttattttgacccaataatggggattcctgcaggaaggctttgccagacaccagatagaccatgcttccgggtctcagaaacagaggcagggtgcagccacctagtctacattttaaaagctaaaaccagtagcctcccatttctctactgtggcaaatgtgagcaccaacactataaattaaaaatgtcactgaaccagttataataatctgctaaataatttgaagaacattgagaccttcaggaaagagctcagcagcctgagtcatctctgcaatagaggacaaggtatacttaagagtctcatcgcttggctgggtgcagcagctcatgctggtaatcccagcactttgggaggccgaggcaggaggattgcttgagcccaggagttcaagaccagcctgggtaacatactgagacctgtctctccaaaaaaaaaaa

SEQ ID NO: 419182 - DNA, 2586 bp, Homo sapiens
gagatgggccagatgccaggatccctgaaaggagaccatatactgtaccatttgatactcatttggggcattatatttatatcccatcaagacaagattccaggaaggtccacacaagtccgcctatgtactctctggatcgaatatttgctggatttcgaacacgaagtcagatgctgttgggtcacatagaagaacaagataaggtcctccactgccaattttctgataacagtgatgatgaagaatcagaaggccaagagaaatctggaactagatgtagaagtcgttcatggattcagaagccagactctgtttgttcccttgttgaattgagtgatactcaggatgaaacacaaaagtcagatttggagaatgaagatttaaagattgattgtctccaggagagtcaagaattgaatttgcaaaaattaaagaattcagaacgcatacttactgaagctaaacaaaaaatgagagacttacaattaacatcaagatgaaggaagatctgattaaagaattaataaaaacaggtaatgatgccaagtctgtaagcaagcagtattctttgaaagtaacaaagctagagcatgatgcagaacaggcaaaagtcgaactgattgaaacacaaaagcagctacaggagctggaaaacaaagatctttctgatgttgcaatgaaggtaaaattacagaaagagtttcgtaaaaagatggatgctgcaaagctgagagttcaggtcttgcagaagaagcaacaagatagtaagaaactggcatcactgtcaatccaaaatgagaaacgtgctaatgagctagagcagagtgtagatcacatgaaatatcaaaagatacagctacaaagaaaactacgagaagaaaatgaaaaaaggaagcaactggatgcagtaattaagcgggaccagcaaaaaatcaaagaaatacaattaaaaacaggacaggaagaaggtctaaaaccgaaagctgaggaccttgatgcatgtaacttgaaaaggagaaaaggttcgtttggaagtatagaccatctccagaaattggatgagcaaaagaaatggttagatgaagaagtagagaaagttctgaaccaacgccaagaattagaggagctggaagcagacttaaagaaacgggaggccatagtttctaagaaggaggctctgttacaggagaagagtcacctggaaaataagaaattgagatctagtcaggaagaacatgttcttttccaacttgaagaagggatagaagctttggaagctgcaattgaatacaggaatgaaagtatccagaatcgccagaagtcacttagagcatcattccataacctctctcgtggtgaagcaaatgtcttggaaaagctagcttgcctgagtcctgttgagattagaactattcttttcagatatttcaataaggtggtgaatttgcgagaagctgaacggaaacaacagttatataatgaagaaatgaaaatgaaagttctggaacgggataatatggttcgtgaattagaatctgcactggaccatctaaaattgcagtgtgaccggagactgaccctccagcaaaaggaacacgaacaaaagatgcagttgctattacatcatttcaaagaacaagatggagaaggcattatggaaactttcaaaacatatgaagataaaatccagcagttggaaaaagatctttatttctataagaaaaccagccgggatcataagaagaaacttaaggaactggtaggggaagcaattcggcggcaactagcaccatcagagtatcaagaggctggagatggagtcctgaagccagaaggaggaggcatgctttcagaagaattaaaatgggcatccagacctgaaagtatgaaattaagtggaagagaaagagaaatggacagttcagcaagcagcttaagaacacagccaaatcctcaaaagctctgggaagatatcccagaattacctccaattcatagttctttagcaccccccagtgggcatatgttaggtaatgagaataaaacagaaacagatgataatcagtttacaaaatctcacagtcgactgtcatcccaaattcaggttgtgggaaatgtgggacgacttcatggtgtcacacctgtaaaactgtgtcgaaaagaattacgtcaaatttccgccttggaactatcattgcgacgttccagtcttggagttggcattggatcaatggctgctgattccatcgaagtatctaggaaaccaagggacttaaaaacttagacattgaataatagaacttttagtagatatgtaaaaagattcctttttctaacctgttaaaaactaaagctcaagttcactacctctttcctcagaataaaggaagaaggggaggaaggaatccctaattcttttatatgctatagatgtgtacatcttctatatatatttggggagttttagtttatattcccatagtaatcaaacatgttttccaatacttgataacatttaaatatttataaatacgcttaaatgtttttccaggcatatttgaagattaaaactagtaatagact

SEQ ID NO: 419183 - DNA, 2802 bp, Homo sapiens
gagatgggccagatgccaggatccctgaaaggagaccatatactgtaccatttgatactcatttggggcattatatttatatcccatcaagacaagattccaggaaggtccacacaagtccgcctatgtactctctggatcgaatatttgctggatttcgaacacgaagtcagatgctgttgggtcacatagaagaacaagataaggtcctccactgccaattttctgataacagtgatgatgaagaatcagaaggccaagagaaatctggaactagatgtagaagtcgttcatggattcagaagccagactctgtttgttcccttgttgaattgagtgatactcaggatgaaacacaaaagtcagatttggagaatgaagatttaaagattgattgtctccaggagagtcaagaattgaatttgcaaaaattaaagaattcagaacgcatacttactgaagctaaacaaaaaatgagagacttacaattaacatcaagatgaaggaagatctgattaaagaattaataaaaacaggtaatgatgccaagtctgtaagcaagcagtattctttgaaagtaacaaagctagagcatgatgcagaacaggcaaaagtcgaactgattgaaacacaaaagcagctacaggagctggaaaacaaagatctttctgatgttgcaatgaaggtaaaattacagaaagagtttcgtaaaaagatggatgctgcaaagctgagagttcaggtcttgcagaagaagcaacaagatagtaagaaactggcatcactgtcaatccaaaatgagaaacgtgctaatgagctagagcagagtgtagatcacatgaaatatcaaaagatacagctacaaagaaaactacgagaagaaaatgaaaaaaggaagcaactggatgcagtaattaagcgggaccagcaaaaaatcaaagaaatacaattaaaaacaggacaggaagaaggtctaaaaccgaaagctgaggaccttgatgcatgtaacttgaaaaggagaaaaggttcgtttggaagtatagaccatctccagaaattggatgagcaaaagaaatggttagatgaagaagtagagaaagttctgaaccaacgccaagaattagaggagctggaagcagacttaaagaaacgggaggccatagtttctaagaaggaggctctgttacaggagaagagtcacctggaaaataagaaattgagatctagtcaggccttaaacacagatagtttgaaaatatcaactcgcctgaacttactggaacaagagttgtctgaaaagaatgtgcagctccagaccagtacagctgaggagaaaacaaagatttcagaacaagttgaagtcctccagaaagaaaaggatcagctccagaaacgcagacacgatgtggatgaaaaacttaaaaatggtagagtgttatcacctgaagaagaacatgttcttttccaacttgaagaagggatagaagctttggaagctgcaattgaatacaggaatgaaagtatccagaatcgccagaagtcacttagagcatcattccataacctctctcgtggtgaagcaaatgtcttggaaaagctagcttgcctgagtcctgttgagattagaactattcttttcagatatttcaataaggtggtgaatttgcgagaagctgaacggaaacaacagttatataatgaagaaatgaaaatgaaagttctggaacgggataatatggttcgtgaattagaatctgcactggaccatctaaaattgcagtgtgaccggagactgaccctccagcaaaaggaacacgaacaaaagatgcagttgctattacatcatttcaaagaacaagatggagaaggcattatggaaactttcaaaacatatgaagataaaatccagcagttggaaaaagatctttatttctataagaaaaccagccgggatcataagaagaaacttaaggaactggtaggggaagcaattcggcggcaactagcaccatcagagtatcaagaggctggagatggagtcctgaagccagaaggaggaggcatgctttcagaagaattaaaatgggcatccagacctgaaagtatgaaattaagtggaagagaaagagaaatggacagttcagcaagcagcttaagaacacagccaaatcctcaaaagctctgggaagatatcccagaattacctccaattcatagttctttagcaccccccagtgggcatatgttaggtaatgagaataaaacagaaacagatgataatcagtttacaaaatctcacagtcgactgtcatcccaaattcaggttgtgggaaatgtgggacgacttcatggtgtcacacctgtaaaactgtgtcgaaaagaattacgtcaaatttccgccttggaactatcattgcgacgttccagtcttggagttggcattggatcaatggctgctgattccatcgaagtatctaggaaaccaagggacttaaaaacttagacattgaataatagaacttttagtagatatgtaaaaagattcctttttctaacctgttaaaaactaaagctcaagttcactacctctttcctcagaataaaggaagaaggggaggaaggaatccctaattcttttatatgctatagatgtgtacatcttctatatatatttggggagttttagtttatattcccatagtaatcaaacatgttttccaatacttgataacatttaaatatttataaatacgcttaaatgtttttccaggcatatttgaagattaaaactagtaatagact

SEQ ID NO: 419184 - DNA, 1021 bp, Homo sapiens
tctagcaggatcccgctgatccgcttaaggaacacgaacaaaagatgcagttgctattacatcatttcaaagaacaagatggagaaggcattatggaaactttcaaaacatatgaagataaaatccagcagttggaaaaagatctttatttctataagaaaaccagccgggatcataagaagaaacttaaggaactggtaggggaagcaattcggcggcaactagcaccatcagagtatcaagaggctggagatggagtcctgaagccagaaggaggaggcatgctttcagaagaattaaaatgggcatccagacctgaaagtatgaaattaagtggaagagaaagagaaatggacagttcagcaagcagcttaagaacacagccaaatcctcaaaagctctgggaagatatcccagaattacctccaattcatagttctttagcaccccccagtgggcatatgttaggtaatgagaataaaacagaaacagatgataatcagtttacaaaatctcacagtcgactgtcatcccaaattcaggttgtgggaaatgtgggacgacttcatggtgtcacacctgtaaaactgtgtcgaaaagaattacgtcaaatttccgccttggaactatcattgcgacgttccagtcttggagttggcattggatcaatggctgctgattccatcgaagtatctaggaaaccaagggacttaaaaacttagacattgaataatagaacttttagtagatatgtaaaaagattcctttttctaacctgttaaaaactaaagctcaagttcactacctctttcctcagaataaaggaagaaggggaggaaggaatccctaattcttttatatgctatagatgtgtacatcttctatatatatttggggagttttagtttatattcccatagtaatcaaacatgttttccaatacttgataacatttaaatatttataaatacgcttaaatgtttttccaggcatatttgaagattaaaactagtaatagact

SEQ ID NO: 419185 - DNA, 3525 bp, Homo sapiens
aaggaaatcagttcaacttttgtgagcggggaaaagcagggctttattgttgtgttacctgggagtctggagtttgaaaagtgctaattaaccttcctctttttccacattacaaacctttttaagcagcgcagcactccctttagatttggctatcctgggtgattttcagacaagaaccattttctctggggaccattcttctgctgggtgccaaggaatataaggcaaatgcccagaagaccttcaggtgactgggcagtcttatcatgggatatttcttctggccctgccccttcccattctgtaatgtgaattagccacaccagaggctgtgaccatggctagtagacagtggcaacatagtcatccccaagatgctaatcttctgctggaactgtcatacgttatcatggtcaatgtaaacctggtttgtgtggggtgattataaatagagtttccctcctctctgtgacagaatcacaggagaaggacccatctcgtggccttcttgttcttagcgcttcacttttacttcatccctcgattcccagctttttctatcatcattttaccaactcctcagatgcaagactttggttatgtcatactcaccaacgttagtccctctcttccaggtgaaaaggtgggtagcggttgggagggagtctccactgaagagcaggaaggtggtagcagggccggcagctctgccacagagctaggggtgcctgtaaggtgccgcctagagcagcctgggagctttgccttcttttgtctctcactagcccttctactctttgtcattgcctgttcttgagtggatctttgagatgaggggacaggattctcctaagggtagagtttcaggaaatgagtgaaaggcaattgacaaatgcaaagaagtagtcactttttaaattgccggcaaagctataattaatccctaggcacaattgtagtttttattttaatgtttgtatgcacaaggccctttaggaaatgagaagttgccatgccagattaatttttttttttttttttggtgggattgccttttgggggttgcagccagaaattgtgggtaatgtgtgtatttttttatttattaaattttaaacaggattgtgcaagcttatgagacaattagataaactcatggaggaggcaggtcctcctgttattagatgattttgtgctctttgggctgacaataatacactcttgggaagtgatggtagagactgatgggaatagtctttctgcctggttgcaagtcccaaatttttaaggcttaatggaagtaagtggatgtttcctcatgttaactactgaatcagatgttaggagcttgtccctttggggttgacttatgcccagcagtacagggacacagcttcattagagtgttagtgtaaactaactccaaagttaggagttaatgtgaaaggatcatccttgaaacaagtctgctgtttgccatgcttgtagtacagaaacttcacatggagttttgggtgggatttgtgttttcacaagtaaaaaatccctcacgattataaaactcagagcatcatctaattttttttttaatgactacaagttccagcacaaaactggcatttctttgccatttcttgccagtaagaagttgacacggaggtatttgaaagcaatgttatgtgagtcattcttaagtgttccaagtaagtttagaaacagaaaaggaacttgggattcaaattgatttttcaaatcatttttaaagagacatcatcctgactaaatcttagcctgaaccttcctcccctgtgtgtattccccggtagtcaccgcagcgagatgctggtgagactgccgtggtggcatttagcatcgttaaaactggaaaactctcaagctctttgccactttcctactattttttgattcttgccattttaccaagcttaggttgtgaaacttgacagaaatgtattacaggaaaaacttataattgtatttgactttctaacacattgcaaagtttcaaagtgactttcactttcaacaacatattagaagtaaccacttttgctttcacagcctgaagagttagagcctgatctgatgccccctttcactctgaagtcatgggaaattttccagccatgaaagccctctttccactgcatactgatgggctgactcagcttccttcagccgactgagatcttttcatactattggctatttcataccaattaacctcttaaataagattgtgaattgccaaaattgatagacacttattaccacctgtggactccatattccttaccacaaatgttattttcatcagtcctgagtcattttaacttacagaaattaggattgttgctgctaatatgaataccaattataacttttagaaacaagaataaagcctaaaagagaatgaaatataagaaatgttcgttcccacccctaataacatttggaagtgaatattcccattttcttccacccacagggattgggattgatttttaatttcctaggaaacaatactagactacccaaaaagatgttgccagaatccaaaaggaactatgctcgtaaaagaaatgcagttttctcctacctaaaaaaaagaaagtaaagtgtgttctgttcttatctttttaatgactaagctttaaacagtttattttgggtaagactagaactttcagccatttgttctaatatctgtgttattagatgcaatagaatttatgaaaagaagaatgacaaaggtatctgattagaaaatttgatcttacgcatgaatccatgtcatggccagccactgtcacatagtgggtgccattctcaacatattggtttgctaactttaagcattagggatttagcacactaaaatacttttaattatattaggtttggtaactaaggagtaaataaatcataatttatcatttgccaaggccaacaaacaacactattgtgctgtttgctctcaatgaagttgaataaaccaggaggcttggcatatcccctttatgttaatcccagctagagattagtaggttgactttcacagcaattgtatattgatccattttaactcatccttgccataatttccaggccagtcaccaggacagaggagatgatggggaaacagagctttagatgaaaactactatgcactactagccttagaggcactggtttcctgttaccactttggcaagtatggatggtctaagtccagtagggcttcatccatggagccattagaactgaggggggagtgttagagatgccatttcaccaggatctttttgctcaggttgtacccatgccaattgaagaacgtgttaaagatgaggaggagagatgtaccattctctcccttaataatgatgttggtttgcaaaacctaaagaaataataacaacagactatttcatactttcaagcaagtctttatactacctgttatttctctaaaattcaaataaagaatttttaaactta

SEQ ID NO: 419186 - DNA, 3511 bp, Homo sapiens
aaggaaatcagttcaacttttgtgagcggggaaaagcagggctttattgttgtgttacctgggagtctggagtttgaaaagtgctaattaaccttcctctttttccacattacaaacctttttaagcagcgcagcactccctttagatttggctatcctgggtgattttcagacaagaaccattttctctggggaccattcttctgctgggtgccaaggaatataaggcaaatgcccagaagaccttcaggtgactgggcagtcttatcatgggatatttcttctggccctgccccttcccattctgtaatgtgaattagccacaccagaggctgtgaccatggctagtagacagtggcaacatagtcatccccaagatgctaatcttctgctggaactgtcatacgttatcatggtcaatgtaaacctggtttgtgtggggtgattataaatagagtttccctcctctctgtgacagaatcacaggagaaggacccatctcgtggccttcttgttcttagcgcttcacttttacttcatccctcgattcccagctttttctatcatcattttaccaactcctcagatgcaagactttggttatgtcatactcaccaacgttagtccctctcttccaggtgaaaaggtgggtagcggttgggagggagtctccactgaagagcaggaaggtggtagcagggccggcagctctgccacagagctaggggtgcctgtaaggtgccgcctagagcagcctgggagctttgccttcttttgtctctcactagcccttctactctttgtcattgcctgttcttgagtggatctttgagatgaggggacaggattctcctaagggtagagtttcaggaaatgagtgaaaggcaattgacaaatgcaaagaagtagtcactttttaaattgccggcaaagctataattaatccctaggcacaattgtagtttttattttaatgtttgtatgcacaaggccctttaggaaatgagaagttgccatgccagattaatttttttttttttttttggtgggattgccttttgggggttgcagccagaaattgtgggtaatgtgtgtatttttttatttattaaattttaaacaggattgtgcaagcttatgagacaattagataaactcatggaggaggcaggtcctcctgttattagatgattttgtgctctttgggctgacaataatacactcttgggaagtgatggtagagactgatgggaatagtctttctgcctggttgcaagtcccaaatttttaaggcttaatggaagtaagtggatgtttcctcatgttaactactgaatcagatgttaggagcttgtccctttggggttgacttatgcccagcagtacagggacacagcttcattagagtgttagtgtaaactaactccaaagttaggagttaatgtgaaaggatcatccttgaaacaagtctgctgtttgccatgcttgtagtacagaaacttcacatggagttttgggtgggatttgtgttttcacaagtaaaaaatccctcacgattataaaactcagagcatcatctaattttttttttaatgactacaagttccagcacaaaactggcatttctttgccatttcttgccagtaagaagttgacacggaggtatttgaaagcaatgttatgtgagtcattcttaagtgttccaagtaagtttagaaacagaaaaggaacttgggattcaaattgatttttcaaatcatttttaaagagacatcatcctgactaaatcttagcctgaaccttcctcccctgtgtgtattccccggtagtcaccgcagcgagatgctggtgagactgccgtggtggcatttagcatcgttaaaactggaaaactctcaagctctttgccactttcctactattttttgattcttgccattttaccaagcttaggttgtgaaacttgacagaaatgtattacaggaaaaacttataattgtatttgactttctaacacattgcaaagtttcaaagtgactttcactttcaacaacatattagaagtaaccacttttgctttcacagcctgaagagttagagcctgatctgatgccccctttcactctgaagtcatgggaaattttccagccatgaaagccctctttccactgcatactgatgggctgactcagcttccttcagccgactgagatcttttcatactattggctatttcataccaattaacctcttaaataagattgtgaattgccaaaattgatagacacttattaccacctgtggactccatattccttaccacaaatgttattttcatcagtcctgagtcattttaacttacagaaattaggattgttgctgctaatatgaataccaattataacttttagaaacaagaataaagcctaaaagagaatgaaatataagaaatgttcgttcccacccctaataacatttggaagtgaatattcccattttcttccacccacagggattgggattgatttttaatttcctaggaaacaatactagactacccaaaaagatgttgccagaatccaaaaggaactatgctcgtaaaagaaatgcagttttctcctacctaaaaaaaagaaagtaaagtgtgttctgttcttatctttttaatgactaagctttaaacagtttattttgggtaagactagaactttcagccatttgttctaatatctgtgttattagatgcaatagaatttatgaaaagaagaatgacaaaggtatctgattagaaaatttgatcttacgcatgaatccatgtcatggccagccactgtcacatagtgggtgccattctcaacatattggtttgctaactttaagcattagggatttagcacactaaaatacttttaattatattaggtttggtaactaaggagtaaataaatcataatttatcatttgccaaggccaacaaacaacactattgtgctgtttgctctcaatgaagttgaataaaccaggaggcttggcatatcccctttatgttaatcccagctagagattagtaggttgactttcacagcaattgtatattgatccattttaactcatccttgccataatttccaggccagtcaccaggacagaggagatgatggggaaacagagctttagatgaaaactactatgcactactagccttagaggcactggtttcctgttaccactttggcaagtatggatggtctaagtccagtagggcttcatccatggagccattagaactgaggggggagtgttagagatgccatttcaccaggatctttttgctcaggttgtacccatgccaattgaagaacgtgttaaagatgaggaggagagatgtaccattctctcccttaataatgatgatgatggtgctgatggaggtaatgatgatgatagtgatgatgaagatggtgatgatggcagtgattatgatggtgattgtgatggtggtactttaaag

SEQ ID NO: 419187 - DNA, 644 bp, Homo sapiens
gagcctgggaaggaagagggaacgggtcctggcggtgctttgcaaagggcccgtgtttctgttgcgggaagctcccgggggtcgcacgtgcgtccgagcccaagcccctcccctccactccccttcctgcgtgccccggagccgccaagcggctacgttcttctcggcccgccgagatggcgctcgaccccgcagaccagcatctcagacatgtcgaaaaagatgttttgatccctaaaataatgagagaaaaggccaaagagaggtgttctgaacaagttcaagattttaccaaatgttgcaagaactctggagttcttatggtagtaaaatgccggaaagaaaattctgcattgaaagaatgtctaactgcttactataatgatccagccttttatgaagaatgcaaaatggaatacctgaaggaaagggaagaattcagaaaaactggaattcctacaaagaaaaggctacagaagcttccaacaagcatgtaggcagatactcaaatgacattcaggaactctaatattcatggaagtcattttatagtccttaaataatggactcaagcatatatgtttgctttaccttaattatggaaatattaactttatctgaaataaatattttatttcaaaaaa

SEQ ID NO: 419188 - DNA, 791 bp, Homo sapiens
ctttggaccacgatgaaattgccaaatgatgcatttctcagaatgtatcctcattgttaagcagcccatgattgtactgtttctctactagaaatcctatctctacatcctgtctctatgaagtctccttgcccttcatctcagaagtcctctctccctcttctcaaatcacatttatttatacaaagtgaatatcactcatcttattctgccttttactggtgtacatgtcttttgttgagcacggtaccatgtgccaagcacaatgtacataatagatgttcaaggctgcagtgagctataatcatgccactgcactccagcctgggtgacaggctttctttttttttttctaaaaagaagaaaattgtgtgtgtgggtatttatatagatataattacaagtaattttttccttccaaatttatttcagattttaccaaatgttgcaagaactctggagttcttatggtagtaaaatgccggaaagaaaattctgcattgaaagaatgtctaactgcttactataatgatccagccttttatgaagaatgcaaaatggaatacctgaaggaaagggaagaattcagaaaaactggaattcctacaaagaaaaggctacagaagcttccaacaagcatgtaggcagatactcaaatgacattcaggaactctaatattcatggaagtcattttatagtccttaaataatggactcaagcatatatgtttgctttaccttaattatggaaatattaactttatctgaaataaatattttatttcaaaaaa

SEQ ID NO: 419189 - DNA, 1593 bp, Homo sapiens
acccccacgaccgaacctggcttcgctaacgccctcccagctccctcgggcctgacttccggtttcctcgcgcgtccctggcgccgagcccgcggacagcggcagccccttttccggctgagagctcatccacacttccaatcactttccggagtgcttcccctccctccggcccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctggttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagtgataatatgcagcatgcatactgggaactgaagagagaaatgtctaatttacatctggtgactcaagtacaagctgaactactaagaaaactgaaaacctcaactgcaatcaagaaaggcaagtcactgtttaccggaaaccactgattccagccaaactgcctgaagagcaactagctgtcatatcttatcaaaatctcatcaaatgagagattgataagccaaagtatatatagtacattcgcagcctacccattctctgctttggcttcagtctcatactggtcaacttcacacataaaggtgttgctgatgtgttttttcttcagtactgtattcttttccccttgtggcttttctcagccaagtgttgcttatgtgtataagactgaggtgttaagtttgctctagttgaccttttaccacagctacttcatatatttg

SEQ ID NO: 419190 - DNA, 716 bp, Homo sapiens
gagcctgggaaggaagagggaacgggtcctggcggtgctttgcaaagggcccgtgtttctgttgcgggaagctcccgggggtcgcacgtgcgtccgagcccaagcccctcccctccactccccttcctgcgtgccccggagccgccaagcggctacgttcttctcggcccgccgagatggcgctcgaccccgcagaccagcatctcagacatgtcgaaaaagatgttttgatccctaaaataatgagagaaaaggccaaagagaggtgttctgaacaagttcaagattttaccaaatgttgcaagaactctggagttcttatggtagtaaaatgccggaaagaaaattctgcattgaaagaatgtctaactgcttactataatgatccagccttttatgaagaatgcaaaatggaatacctgaaggaaagggaagaattcagaaaaactggaattcctacaaagaaaaggctacagaagcttccaacaagcatgtaggcagatactcaaatgacattcaggaactctaatattcatggaagtcattttatagtccttaaataatggactcaagcatatatgtttgctttaccttaattatggaaatattaactttatctgaaataaatattttatttcaaaaaaaaaaccacaacaaaaggcagaaaaaaacactttgggggcccgcctgggcccccggaaaagcttccaaacacc

SEQ ID NO: 419191 - DNA, 1413 bp, Homo sapiens
gcggtcggtcgggaggtgtgggatgataattgcttgattaatgttttgaacaataccaagaaattgtttaattaaaataaatatttttgtttgaaattgaagtggatgtgaaatattgtccttgcctatagatctcaaaatctagtactaattgttggttgttaatatgattcatacaatagacatttgttaaaccagcttttgagtggagaaaattattttccatttaaacagtacagtgatgatagctatcaaacaggtatactaaaaagtcagtgactgtgacagtttaaagtgttagacaaatgatgtataaggttctttagtaaggaaagattagccaaaaattttttacccagctagaagcttttaaatctacacttgatatctctgttctaggtaaaattcaaacaaccaaaaaacagtggcccatctgtagcttatgaatctatttaaaattgaatattttatgttgacttctttcatactagctgaaacttgctctaaagagcttcctttggaatctttagatttctttttataaggttcaattcagtacatccataaatcgacagaatgaagaaaacataacaaaaagccacctattccttcctcttgctcccttattagctaaagtaaaatttacatctgtaagacttactgagttgctgccaaaatggaactgaattcttaaaagcaggaacgtgcctatgtgaaacattagaaaaccaaaataaatgggaaaattcagacttgaagagctgaatcatgtgacaacaaagtactgatcttaattcagaaaggctacttggagaaggtgtatcttaaggggtaaaaaacctgtgggttaccacatattaacagggaataatatcaacagaggcacccataagcaagcaagacacaactgagacagatgtaccaggtgaaaaaaatcttcagtatggatacacatgggtattctgaaggctacaatgaatggtttagtctttgacataaggaggatgaacatattatttatactgtgtaatctaatctggcttctatggggaaagcaacatgtacataagtgaattttctacatgaagtgggctacttctgattttaatcaaagctataaaatagattgtatatttcactagcttcttaaagtaactcttccattttcatttatctctaaaaacagttaacttcctgtgctctaggaaatgcaccaataccaaaggtcaatgtggaaatatgggcatgtttgcccctatgctgtgtggtctctagatttctatatttgctttgcttttgtctgctctagtaatctccctccttttgatctgtggcctgggaaaatgtggtttctttgtatttcaaataaaagtaaaatagttttttgagtggttcactcaagaaaaaaaaatg

SEQ ID NO: 419192 - DNA, 510 bp, Homo sapiens
gaaaagataacaatttcagtgtccatcctttttgtagtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagacagagtatctgtagcacagcctggagtgcagtggcgcaatcatgggatagcatgaattttgaggactgttccctcttcgcataagaatagaagtagccatcagagttcatatactttttcaaccctttttcctcaaatacgtatcatttttacttaagtaacttcaattctgtgttttaagctatctaataattgttgtttctactatgttaagatagcctctctacattgttaccctccatccaataaaaaatactgatctga

SEQ ID NO: 419193 - DNA, 974 bp, Homo sapiens
ctaggctaggtacgaggctgggtgtgaatcggccgaggaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagtgataatatgcagcatgcatactgggaactgaagagagaaatgtctaatttacatctggtgactcaagtacaagctgaactactaagaaaactgaaaacctcaactgcaatcaagaaaggcaagtcactgtttaccggaaaccactgattccagccaaactgcctgaagagcaactagctgtcatatcttatcaaaatctcatcaaatgagagattgataagccaaagtatatatagtacattcgcagcctacccattctctgctttggcttcagtctcatactggtcaacttcacacataaaggtgttgctgatgtgttttttcttcagtactgtattcttttccccttgtggcttttctcagccaagtgttgcttatgtgtataagactgaggtgttaagtttgctctagttgaccttttaccacagctacttcatatatttg

SEQ ID NO: 419194 - DNA, 398 bp, Homo sapiens
gatgtgtgaattttttttaatttgtaaagaataaaatttattttaccaaatgttgcaagaactctggagttcttatggtagtaaaatgccggaaagaaaattctgcattgaaagaatgtctaactgcttactataatgatccagccttttatgaagaatgcaaaatggaatacctgaaggaaagggaagaattcagaaaaactggaattcctacaaagaaaaggctacagaagcttccaacaagcatgtaggcagatactcaaatgacattcaggaactctaatattcatggaagtcattttatagtccttaaataatggactcaagcatatatgtttgctttaccttaattatggaaatattaactttatctgaaataaatattttatttcaaaaaa

SEQ ID NO: 419195 - DNA, 1106 bp, Homo sapiens
acccccacgaccgaacctggcttcgctaacgccctcccagctccctcgggcctgacttccggtttcctcgcgcgtccctggcgccgagcccgcggacagcggcagccccttttccggctgagagctcatccacacttccaatcactttccggagtgcttcccctccctccggcccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctgggaacctaactctcagagaagtaatgctgaacctaacagcaaaagtagatgttcagagcaagtcagtttttcgttaaacaatgaagttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaaggtaatttttatcttttaccttcattgcgtttgtgacataaggaataattcaaaatacttgaaattttgaatactttttgtcctgtcttccatgattgtactaaatttccaagaataactcactgctaatctgaaaactctgggcattatacttatcctgtgtttcacataccatgtacttggtaaatatttgtaggagaggatttaacaacttggagttatattccaaatatttttctttcattttcaggtttacttacctccatagctgtatgtattttattcagaattttcaaatctgggca

SEQ ID NO: 419196 - DNA, 332 bp, Homo sapiens
ttaaaattgagtataaaatctaattgtattctttgcacttacagatatattctgtaaaacctgaacatgtctctggtaagaaagagctgagactaaataaattgtaaaaattacaacttttaaacttcttttttttaaacaaatgacaggatccatatcaggaagacaatctgaagagcagagatctccaaaaactaagcatttcaaggtatgaccactcttcagcattaagacaatacgttgtcttcttccataagtcactttgtgtaggtccttagatttcttttatgacttaaccttaaaaacaaaaaatggatattgtttggatactg

SEQ ID NO: 419197 - DNA, 3368 bp, Homo sapiens
acccccacgaccgaacctggcttcgctaacgccctcccagctccctcgggcctgacttccggtttcctcgcgcgtccctggcgccgagcccgcggacagcggcagccccttttccggctgagagctcatccacacttccaatcactttccggagtgcttcccctccctccggcccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctggttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagtgataatatgcagcatgcatactgggaactgaagagagaaatgtctaatttacatctggtgactcaagtacaagctgaactactaagaaaactgaaaacctcaactgcaatcaagaaagcctgtgcccctgtaggatgcagtgaagaccttggaagagacagcacaaaactgcacttgatgaattttactgcaacatacacaagacatccccctctcttaccaaatggcaaagctctttgtcataccacatcttcccctttaccaggagatgtaaaggttttatcagagaaagcaatcctccaatcatggacagacaatgagagatccattcctaatgatggtacatgctttcaggaacacagttcttatggcagaaattctctggaagacaattcctgggtatttccaagtcctcctaaatcaagtgagacagcatttggggaaactaaaactaaaactttgcctttacccaaccttccaccactgcattacttggatcaacataatcagaactgcctttataagaattaatttggaagagattcacgatttcaccatgaggacacttatctctttcagtggtcctcccaagaaattatttaacaaactgaaaggagattttgattaaaattttgcagaggtcttcagtatctatatttgaacacactgtacaatagtacaaaaaccaacatagttggttttctagtatgaaagagcaccctctagctccatattctaagaatctgaaatatgctactatactaattaataagtaaacttaaggtgtttaaaaaactctgccttctatattaattgtaaaattttgcctctcagaagaatggaattggagattgtagacgtggttttacaaaatgtgaaatgtctaaatatctgttcataaaaataaaaggaaaacatgtttcttcaaattgcataatggaacaaatggcaatgtgagtaggttacatttctgttgttataatgcgtaaagatattgaaaatataatgaaataaaagcatcttaggttataccatctttatatgctattgcgtttcaatatttaagatttaaagtgattttttggtcacagtgttttgttgataaaatttttttagaattgaagtttgaattctaagacttgaaacaacctgatcactgaagccaactttgtcccagcacattccttaagtcctaattgggaaaaaaaaaaaaaaaaatgaaatagttgaaaaactctggggtgtaaacaaatgattgtaaccctacacactattcaataagtagtagaaggagcatcacacagatttcagtctaatctgcccttctgtgggccataatataaacataaatgtgtgtaatgataaaaagtcattttcttcaaagagactacagctagctgcacattgtgtagagcagcttctaaattgttagactttgtgttgaaatgtaatattctatttattgagaaagtgatttaaaattattatttttaatcatagaaatcagggtttgggctgtattgatattgtcgatcatgaaatgtccacacttattctaagtggccaattatttggaaataaagaaggaaataaagatggcttcacatggaaatttaagttctttcagggtggagatttacttggttcatacaccttttgcctgaattaaagtatttcatgtaggaggacttttatcctttttgatagacagtttcatatatcttgaactcaatatctcagatctcttctactgtattactgaatagcatacatacatagacaatgttcgccattcactagatatttttttctattatcttacacttattcaagcttgtctgtgattaatggaattggtgtcagatgctggaatttattctgaccaatgaacacagctgactcaggggagtacaatctcctgccaagtaatagaaccaaacccaatatgcataaaagaaatacaatactccaggctttagctgaaggaagcaactacctgtgtaataacaaagcagcaaaaactatttctcatgtggctgcataggctgtatattatatctgatctctaatgtagcttactggtttgccttttttaaaaccaaaattggaaattttcctttgtaaagaaaaaaagtcttatgagataattgcttgattaatgttttgaacaataccaagaaattgtttaattaaaataaatatttttgtttgaaattgaa

SEQ ID NO: 419198 - DNA, 3886 bp, Homo sapiens
acccccacgaccgaacctggcttcgctaacgccctcccagctccctcgggcctgacttccggtttcctcgcgcgtccctggcgccgagcccgcggacagcggcagccccttttccggctgagagctcatccacacttccaatcactttccggagtgcttcccctccctccggcccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctggttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagtgataatatgcagcatgcatactgggaactgaagagagaaatgtctaatttacatctggtgactcaagtacaagctgaactactaagaaaactgaaaacctcaactgcaatcaagaaagcctgtgcccctgtaggatgcagtgaagaccttggaagagacagcacaaaactgcacttgatgaattttactgcaacatacacaagacatccccctctcttaccaaatggcaaagctctttgtcataccacatcttcccctttaccaggagatgtaaaggttttatcagagaaagcaatcctccaatcatggacagacaatgagagatccattcctaatgatggtacatgctttcaggaacacagttcttatggcagaaattctctggaagacaattcctgggtatttccaagtcctcctaaatcaagtgagacagcatttggggaaactaaaactaaaactttgcctttacccaaccttccaccactgcattacttggatcaacataatcagaactgcctttataagaattaatttggaagagattcacgatttcaccatgaggacacttatctctttcagtggtcctcccaagaaattatttaacaaactgaaaggagattttgattaaaattttgcagaggtcttcagtatctatatttgaacacactgtacaatagtacaaaaaccaacatagttggttttctagtatgaaagagcaccctctagctccatattctaagaatctgaaatatgctactatactaattaataagtaaacttaaggtgtttaaaaaactctgccttctatattaattgtaaaattttgcctctcagaagaatggaattggagattgtagacgtggttttacaaaatgtgaaatgtctaaatatctgttcataaaaataaaaggaaaacatgtttcttcaaattgcataatggaacaaatggcaatgtgagtaggttacatttctgttgttataatgcgtaaagatattgaaaatataatgaaataaaagcatcttaggttataccatctttatatgctattgcgtttcaatatttaagatttaaagtgattttttggtcacagtgttttgttgataaaatttttttagaattgaagtttgaattctaagacttgaaacaacctgatcactgaagccaactttgtcccagcacattccttaagtcctaattgggaaaaaaaaaaaaaaaaatgaaatagttgaaaaactctggggtgtaaacaaatgattgtaaccctacacactattcaataagtagtagaaggagcatcacacagatttcagtctaatctgcccttctgtgggccataatataaacataaatgtgtgtaatgataaaaagtcattttcttcaaagagactacagctagctgcacattgtgtagagcagcttctaaattgttagactttgtgttgaaatgtaatattctatttattgagaaagtgatttaaaattattatttttaatcatagaaatcagggtttgggctgtattgatattgtcgatcatgaaatgtccacacttattctaagtggccaattatttggaaataaagaaggaaataaagatggcttcacatggaaatttaagttctttcagggtggagatttacttggttcatacaccttttgcctgaattaaagtatttcatgtaggaggacttttatcctttttgatagacagtttcatatatcttgaactcaatatctcagatctcttctactgtattactgaatagcatacatacatagacaatgttcgccattcactagatatttttttctattatcttacacttattcaagcttgtctgtgattaatggaattggtgtcagatgctggaatttattctgaccaatgaacacagctgactcaggggagtacaatctcctgccaagtaatagaaccaaacccaatatgcataaaagaaatacaatactccaggctttagctgaaggaagcaactacctgtgtaataacaaagcagcaaaaactatttctcatgtggctgcataggctgtatattatatctgatctctaatgtagcttactggtttgccttttttaaaaccaaaattggaaattttcctttgtaaagaaaaaaagtcttatgagataattgcttgattaatgttttgaacaataccaagaaattgtttaattaaaataaatatttttgtttgaaattgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttggggggggccccggtccccaattcccccttagggggggcgttttaaaattcaggggcccgtttttaaaaaactttgaaatggaaaaaccttgggtttcccaaatttaaaccctttggaaaaaattccctttttcccaattgggcaaaaagccaaaaggccccaaccttttcccttttcaaaaaatttgccaccttaaagggcaaatggcaaattttaagctttaaatttttttaaaaattcgtgtaaaatttttgtaaaaaccgcttttttttaaacccaagggcccaaattgggaaaatccttttataaataaaaaaattaccccgaaaagggttaaatttttttcccattgggaaacaagtttcccttttaaaaaaatgggcctcc

SEQ ID NO: 419199 - DNA, 3253 bp, Homo sapiens
acccccacgaccgaacctggcttcgctaacgccctcccagctccctcgggcctgacttccggtttcctcgcgcgtccctggcgccgagcccgcggacagcggcagccccttttccggctgagagctcatccacacttccaatcactttccggagtgcttcccctccctccggcccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctggttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagtgataatatgcagcatgcatactgggaactgaagagagaaatgtctaatttacatctggtgactcaagtacaagctgaactactaagaaaactgaaaacctcaactgcaatcaagaaagcctgtgcccctgtaggatgcagtgaagaccttggaagagacagcacaaaactgcacttgatgaattttactgcaacatacacaagacatccccctctcttaccaaatggcaaagctctttgtcataccacatcttcccctttaccaggagatgtaaaggttttatcagagaaagcaatcctccaatcatggacagacaatgagagatccattcctaatgatggtacatgctttcaggaacacagttcttatggcagaaattctctggaagacaattcctgggtatttccaagtcctcctaaatcaagtgagacagcatttggggaaactaaaactaaaactttgcctttacccaaccttccaccactgcattacttggatcaacataatcagaactgcctttataagaattaatttggaagagattcacgatttcaccatgaggacacttatctctttcagtggtcctcccaagaaattatttaacaaactgaaaggagattttgattaaaattttgcagaggtcttcagtatctatatttgaacacactgtacaatagtacaaaaaccaacatagttggttttctagtatgaaagagcaccctctagctccatattctaagaatctgaaatatgctactatactaattaataagtaaacttaaggtgtttaaaaaactctgccttctatattaattgtaaaattttgcctctcagaagaatggaattggagattgtagacgtggttttacaaaatgtgaaatgtctaaatatctgttcataaaaataaaaggaaaacatgtttcttcaaattgcataatggaacaaatggcaatgtgagtaggttacatttctgttgttataatgcgtaaagatattgaaaatataatgaaataaaagcatcttaggttataccatctttatatgctattgcgtttcaatatttaagatttaaagtgattttttggtcacagtgttttgttgataaaatttttttagaattgaagtttgaattctaagacttgaaacaacctgatcactgaagccaactttgtcccagcacattccttaagtcctaattgggaaaaaaaaaaaaaaaaatgaaatagttgaaaaactctggggtgtaaacaaatgattgtaaccctacacactattcaataagtagtagaaggagcatcacacagatttcagtctaatctgcccttctgtgggccataatataaacataaatgtgtgtaatgataaaaagtcattttcttcaaagagactacagctagctgcacattgtgtagagcagcttctaaattgttagactttgtgttgaaatgtaatattctatttattgagaaagtgatttaaaattattatttttaatcatagaaatcagggtttgggctgtattgatattgtcgatcatgaaatgtccacacttattctaagtggccaattatttggaaataaagaaggaaataaagatggcttcacatggaaatttaagttctttcagggtggagatttacttggttcatacaccttttgcctgaattaaagtatttcatgtaggaggacttttatcctttttgatagacagtttcatatatcttgaactcaatatctcagatctcttctactgtattactgaatagcatacatacatagacaatgttcgccattcactagatatttttttctattatcttacacttattcaagcttgtctgtgattaatggaattggtgtcagatgctggaatttattctgaccaatgaacacagctgactcaggggagtacaatctcctgccaagtaatagaaccaaacccaatatgcttaggagtcatactccaggctagcgaaggagcataccggtctaccaagcgaaatatcccgggggccaggcggaaaacaaaccaagcgagggggggcgttaaccaggagtgcctgcacagctccaaaccgcggggcccccgcgttcgtgcggggcc

SEQ ID NO: 419200 - DNA, 3504 bp, Homo sapiens
acccccacgaccgaacctggcttcgctaacgccctcccagctccctcgggcctgacttccggtttcctcgcgcgtccctggcgccgagcccgcggacagcggcagccccttttccggctgagagctcatccacacttccaatcactttccggagtgcttcccctccctccggcccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctgggaggtcttaaaaggttttagccacagtttctccttccatcatgtttttcaggaacctaactctcagagaagtaatgctgaacctaacagcaaaagtagatgttcagagcaagtcagtttttcgttaaacaatgaagttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagtgataatatgcagcatgcatactgggaactgaagagagaaatgtctaatttacatctggtgactcaagtacaagctgaactactaagaaaactgaaaacctcaactgcaatcaagaaagcctgtgcccctgtaggatgcagtgaagaccttggaagagacagcacaaaactgcacttgatgaattttactgcaacatacacaagacatccccctctcttaccaaatggcaaagctctttgtcataccacatcttcccctttaccaggagatgtaaaggttttatcagagaaagcaatcctccaatcatggacagacaatgagagatccattcctaatgatggtacatgctttcaggaacacagttcttatggcagaaattctctggaagacaattcctgggtatttccaagtcctcctaaatcaagtgagacagcatttggggaaactaaaactaaaactttgcctttacccaaccttccaccactgcattacttggatcaacataatcagaactgcctttataagaattaatttggaagagattcacgatttcaccatgaggacacttatctctttcagtggtcctcccaagaaattatttaacaaactgaaaggagattttgattaaaattttgcagaggtcttcagtatctatatttgaacacactgtacaatagtacaaaaaccaacatagttggttttctagtatgaaagagcaccctctagctccatattctaagaatctgaaatatgctactatactaattaataagtaaacttaaggtgtttaaaaaactctgccttctatattaattgtaaaattttgcctctcagaagaatggaattggagattgtagacgtggttttacaaaatgtgaaatgtctaaatatctgttcataaaaataaaaggaaaacatgtttcttcaaattgcataatggaacaaatggcaatgtgagtaggttacatttctgttgttataatgcgtaaagatattgaaaatataatgaaataaaagcatcttaggttataccatctttatatgctattgcgtttcaatatttaagatttaaagtgattttttggtcacagtgttttgttgataaaatttttttagaattgaagtttgaattctaagacttgaaacaacctgatcactgaagccaactttgtcccagcacattccttaagtcctaattgggaaaaaaaaaaaaaaaaatgaaatagttgaaaaactctggggtgtaaacaaatgattgtaaccctacacactattcaataagtagtagaaggagcatcacacagatttcagtctaatctgcccttctgtgggccataatataaacataaatgtgtgtaatgataaaaagtcattttcttcaaagagactacagctagctgcacattgtgtagagcagcttctaaattgttagactttgtgttgaaatgtaatattctatttattgagaaagtgatttaaaattattatttttaatcatagaaatcagggtttgggctgtattgatattgtcgatcatgaaatgtccacacttattctaagtggccaattatttggaaataaagaaggaaataaagatggcttcacatggaaatttaagttctttcagggtggagatttacttggttcatacaccttttgcctgaattaaagtatttcatgtaggaggacttttatcctttttgatagacagtttcatatatcttgaactcaatatctcagatctcttctactgtattactgaatagcatacatacatagacaatgttcgccattcactagatatttttttctattatcttacacttattcaagcttgtctgtgattaatggaattggtgtcagatgctggaatttattctgaccaatgaacacagctgactcaggggagtacaatctcctgccaagtaatagaaccaaacccaatatgcataaaagaaatacaatactccaggctttagctgaaggaagcaactacctgtgtaataacaaagcagcaaaaactatttctcatgtggctgcataggctgtatattatatctgatctctaatgtagcttactggtttgccttttttaaaaccaaaattggaaattttcctttgtaaagaaaaaaagtcttatgagataattgcttgattaatgttttgaacaataccaagaaattgtttaattaaaataaatatttttgtttgaaattgaa

SEQ ID NO: 419201 - DNA, 3398 bp, Homo sapiens
caatcctattaattcctatcctgtaatataaaggatttaacaaattaacacacacatctatttcttaaaaagtcaagtatgccttggctgggcacggtggctcacacctgtaattccagccctttgggaggccgaggtgggtggattgcctgaagtcaggagtccaagaccagactggccaacatggtgaaaccctgtctctactaaaaatacaaaaattagcagggcgtggtggtgcacctatattcccagctcctcggaagctgaggcaggacaatcacttaaacctgggaggcggaggttgcagtgagctgagatcgccccattgcactccagcctgggtgatgagagcgaaactcagtctcgaaaaaaaaaaaaagtcaagtatgccctaaggtgctgctttttctgattatagaaattagatacttttaatttaaaaaacatctaagcagtgtgtatcacatctatactctgttgtgattatgatgatttaatgttataaaacagacaccatgaattataaaatactgattatgtaaaagcatagaaggcttcaaaaaatattctacacatttttgctttctatgtaaagattaatttgtggaaatgaaatactcacctaatgaatccaggctttatccccttattacgattgaagtaagatatggagccatcagaacactgacttattttttatctatagaatactctcttaagctttctcttctaatttcataccgttagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagtgataatatgcagcatgcatactgggaactgaagagagaaatgtctaatttacatctggtgactcaagtacaagctgaactactaagaaaactgaaaacctcaactgcaatcaagaaagcctgtgcccctgtaggatgcagtgaagaccttggaagagacagcacaaaactgcacttgatgaattttactgcaacatacacaagacatccccctctcttaccaaatggcaaagctctttgtcataccacatcttcccctttaccaggagatgtaaaggttttatcagagaaagcaatcctccaatcatggacagacaatgagagatccattcctaatgatggtacatgctttcaggaacacagttcttatggcagaaattctctggaagacaattcctgggtatttccaagtcctcctaaatcaagtgagacagcatttggggaaactaaaactaaaactttgcctttacccaaccttccaccactgcattacttggatcaacataatcagaactgcctttataagaattaatttggaagagattcacgatttcaccatgaggacacttatctctttcagtggtcctcccaagaaattatttaacaaactgaaaggagattttgattaaaattttgcagaggtcttcagtatctatatttgaacacactgtacaatagtacaaaaaccaacatagttggttttctagtatgaaagagcaccctctagctccatattctaagaatctgaaatatgctactatactaattaataagtaaacttaaggtgtttaaaaaactctgccttctatattaattgtaaaattttgcctctcagaagaatggaattggagattgtagacgtggttttacaaaatgtgaaatgtctaaatatctgttcataaaaataaaaggaaaacatgtttcttcaaattgcataatggaacaaatggcaatgtgagtaggttacatttctgttgttataatgcgtaaagatattgaaaatataatgaaataaaagcatcttaggttataccatctttatatgctattgcgtttcaatatttaagatttaaagtgattttttggtcacagtgttttgttgataaaatttttttagaattgaagtttgaattctaagacttgaaacaacctgatcactgaagccaactttgtcccagcacattccttaagtcctaattgggaaaaaaaaaaaaaaaaatgaaatagttgaaaaactctggggtgtaaacaaatgattgtaaccctacacactattcaataagtagtagaaggagcatcacacagatttcagtctaatctgcccttctgtgggccataatataaacataaatgtgtgtaatgataaaaagtcattttcttcaaagagactacagctagctgcacattgtgtagagcagcttctaaattgttagactttgtgttgaaatgtaatattctatttattgagaaagtgatttaaaattattatttttaatcatagaaatcagggtttgggctgtattgatattgtcgatcatgaaatgtccacacttattctaagtggccaattatttggaaataaagaaggaaataaagatggcttcacatggaaatttaagttctttcagggtggagatttacttggttcatacaccttttgcctgaattaaagtatttcatgtaggaggacttttatcctttttgatagacagtttcatatatcttgaactcaatatctcagatctcttctactgtattactgaatagcatacatacatagacaatgttcgccattcactagatatttttttctattatcttacacttattcaagcttgtctgtgattaatggaattggtgtcagatgctggaatttattctgaccaatgaacacagctgactcaggggagtacaatctcctgccaagtaatagaaccaaacccaatatgcataaaagaaatacaatactccaggctttagctgaaggaagcaactacctgtgtaataacaaagcagcaaaaactatttctcatgtggctgcataggctgtatattatatctgatctctaatgtagcttactggtttgccttttttaaaaccaaaattggaaattttcctttgtaaagaaaaaaagtcttatgagataattgcttgattaatgttttgaacaataccaagaaattgtttaattaaaataaatatttttgtttgaaattgaa

SEQ ID NO: 419202 - DNA, 2465 bp, Homo sapiens
gaaaagataacaatttcagtgtccatcctttttgtagtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagtgataatatgcagcatgcatactgggaactgaagagagaaatgtctaatttacatctggtgactcaagtacaagctgaactactaagaaaactgaaaacctcaactgcaatcaagaaagcctgtgcccctgtaggatgcagtgaagaccttggaagagacagcacaaaactgcacttgatgaattttactgcaacatacacaagacatccccctctcttaccaaatggcaaagctctttgtcataccacatcttcccctttaccaggagatgtaaaggttttatcagagaaagcaatcctccaatcatggacagacaatgagagatccattcctaatgatggtacatgctttcaggaacacagttcttatggcagaaattctctggaagacaattcctgggtatttccaagtcctcctaaatcaagtgagacagcatttggggaaactaaaactaaaactttgcctttacccaaccttccaccactgcattacttggatcaacataatcagaactgcctttataagaattaatttggaagagattcacgatttcaccatgaggacacttatctctttcagtggtcctcccaagaaattatttaacaaactgaaaggagattttgattaaaattttgcagaggtcttcagtatctatatttgaacacactgtacaatagtacaaaaaccaacatagttggttttctagtatgaaagagcaccctctagctccatattctaagaatctgaaatatgctactatactaattaataagtaaacttaaggtgtttaaaaaactctgccttctatattaattgtaaaattttgcctctcagaagaatggaattggagattgtagacgtggttttacaaaatgtgaaatgtctaaatatctgttcataaaaataaaaggaaaacatgtttcttcaaattgcataatggaacaaatggcaatgtgagtaggttacatttctgttgttataatgcgtaaagatattgaaaatataatgaaataaaagcatcttaggttataccatctttatatgctattgcgtttcaatatttaagatttaaagtgattttttggtcacagtgttttgttgataaaatttttttagaattgaagtttgaattctaagacttgaaacaacctgatcactgaagccaactttgtcccagcacattccttaagtcctaattgggaaaaaaaaaaaaaaaaatgaaatagttgaaaaactctggggtgtaaacaaatgattgtaaccctacacactattcaataagtagtagaaggagcatcacacagatttcagtctaatctgcccttctgtgggccataatataaacataaatgtgtgtaatgataaaaagtcattttcttcaaagagactacagctagctgcacattgtgtagagcagcttctaaattgttagactttgtgttgaaatgtaatattctatttattgagaaagtgatttaaaattattatttttaatcatagaaatcagggtttgggctgtattgatattgtcgatcatgaaatgtccacacttattctaagtggccaattatttggaaataaagaaggaaataaagatggcttcacatggaaatttaagttctttcagggtggagatttacttggttcatacaccttttgcctgaattaaagtatttcatgtaggaggacttttatcctttttgatagacagtttcatatatcttgaactcaatatctcagatctcttctactgtattactgaatagcatacatacatagacaatgttcgccattcactagatatttttttctattatcttacacttattcaagcttgtctgtgattaatggaattggtgtcagatgctggaatttattctgaccaatgaacacagctgactcaggggagtacaatctcctgccaagtaatagaaccaaacccaatatgcataaaagaaatacaatactccaggctttagctgaaggaagcaactacctgtgtaataacaaagcagcaaaaactatttctcatgtggctgcataggctgtatattatatctgatctctaatgtagcttactggtttgccttttttaaaaccaaaattggaaattttcctttgtaaagaaaaaaagtcttatgagataattgcttgattaatgttttgaacaataccaagaaattgtttaattaaaataaatatttttgtttgaaattgaa

SEQ ID NO: 419203 - DNA, 1413 bp, Homo sapiens
acccccacgaccgaacctggcttcgctaacgccctcccagctccctcgggcctgacttccggtttcctcgcgcgtccctggcgccgagcccgcggacagcggcagccccttttccggctgagagctcatccacacttccaatcactttccggagtgcttcccctccctccggcccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctggttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagacagagtatctgtagcacagcctggagtgcagtggcgcaatcatgggatagcatgaattttgaggactgttccctcttcgcataagaatagaagtagccatcagagttcatatactttttcaaccctttttcctcaaatacgtatcatttttacttaagtaacttcaattctgtgttttaagctatctaataattgttgtttctactatgttaagatagcctctctacattgttaccctccatccaataaaaaatactgatctga

SEQ ID NO: 419204 - DNA, 1385 bp, Homo sapiens
acccccacgaccgaacctggcttcgctaacgccctcccagctccctcgggcctgacttccggtttcctcgcgcgtccctggcgccgagcccgcggacagcggcagccccttttccggctgagagctcatccacacttccaatcactttccggagtgcttcccctccctccggcccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctggttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgataatatgcagcatgcatactgggaactgaagagagaaatgtctaatttacatctggtgactcaagtacaagctgaactactaagaaaactgaaaacctcaactgcaatcaagaaaggcaagtcactgtttaccggaaaccactgattccagccaaactgcctgaagagcaactagctgtcatatcttatcaaaatctcatcaaatgagagattgataagccaaagtatatatagtacattcgcagcctacccattctctgctttggcttcagtctcatactggtcaacttcacacataaaggtgttgctgatgtgttttttcttcagtactgtattcttttccccttgtggcttttctcagccaagtgttgcttatgtgtataagactgaggtgttaagtttgctctagttgaccttttaccacagctacttcatatatttg

SEQ ID NO: 419205 - DNA, 966 bp, Homo sapiens
ctgattctcattcctttatgtaggcagtgtttattcccttttgaagcttttaggattttggggtttcagacatttcatcagagtgcatttagaccagcatctcagacatgtcgaaaaagatgttttgatccctaaaataatgagagaaaaggccaaagagaggtgttctgaacaagttcaaggacaagtaaatttttgtgaaacattgcagatgttagatggatttgggagaattttccaaactaagtggacgaacttatatagctacataaatagtatttaattttaaatgtgtcactgccttgctgctccattggagacttcctgagggcaacagacaaactatttgatagctgaatacatatttggtaactcatatggctcattggatatgaattttggaaatctatgcttccagattactttgcttaattcttgcgtcctcatactttttctgtgaagggatatatacctaagacactaggaaaagcacatccgagattttaccaaatgttgcaagaactctggagttcttatggtagtaaaatgccggaaagaaaattctgcattgaaagaatgtctaactgcttaataactgaatgaaaatatctctgagacttcctccagccttgtgatttgttggattaatataatttaactcctagaaagttgagataaatcgtatggatgataaaaagctataatgatccagccttttatgaagaatgcaaaatggaatacctgaaggaaagggaagaattcagaaaaactggaattcctacaaagaaaaggctacagaagcttccaacaagcatgtaggcagatactcaaatgacattcaggaactctaatattcatggaagtcattttatagtccttaaataatggactcaagcatatatgtttgctttaccttaattatggaaatattaactttatctgaaataaatattttatttcaaaaaa

SEQ ID NO: 419206 - DNA, 688 bp, Homo sapiens
gttctgtaaaatctttgttaactgtcttcctaagaccttttatattttacatatagcattaaatttgaactatatggatttcaaataaaagaagagaataattgctattttcgaagaactcattttaattggttagagtaaatatgaaggcagtgatttttgtaaaatggcctttaacatattaatgtctggttatgtagaaagtgctgtaacaggatcatctgttctactataacttcatgtatgcctattaatgatacataactgtggagcaataatgtaagtgagctctgtcaaaaaaattacataaatgaattgcagtcaggagaaccttactcagtggttatgtatacaaaatttacccccccttgatatgaaaaaattttttataattgctttattttcttacggaataggcttctaaagttgcgaattgtattattgttaagtagcaaaatttgggggtagtatttcctttttgtcatgtgaaataaatttttctcttttacaatacaggacaagtaaatttttgtgaaacattgcagatgttagatggatttgggagaattttccaaactaagtggacgaacttatatagctacataaatagtagtgagtaccagaagtttattaatttgcttatattacataaaaataaaatgctttagtcatgagttaaaaagctaat

SEQ ID NO: 419207 - DNA, 554 bp, Homo sapiens
gagcctgggaaggaagagggaacgggtcctggcggtgctttgcaaagggcccgtgtttctgttgcgggaagctcccgggggtcgcacgtgcgtccgagcccaagcccctcccctccactccccttcctgcgtgccccggagccgccaagcggctacgttcttctcggcccgccgagatggcgctcgaccccgcagattttaccaaatgttgcaagaactctggagttcttatggtagtaaaatgccggaaagaaaattctgcattgaaagaatgtctaactgcttactataatgatccagccttttatgaagaatgcaaaatggaatacctgaaggaaagggaagaattcagaaaaactggaattcctacaaagaaaaggctacagaagcttccaacaagcatgtaggcagatactcaaatgacattcaggaactctaatattcatggaagtcattttatagtccttaaataatggactcaagcatatatgtttgctttaccttaattatggaaatattaactttatctgaaataaatattttatttcaaaaaa

SEQ ID NO: 419208 - DNA, 1549 bp, Homo sapiens
acccccacgaccgaacctggcttcgctaacgccctcccagctccctcgggcctgacttccggtttcctcgcgcgtccctggcgccgagcccgcggacagcggcagccccttttccggctgagagctcatccacacttccaatcactttccggagtgcttcccctccctccggcccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctgggaggtcttaaaaggttttagccacagtttctccttccatcatgtttttcaggaacctaactctcagagaagtaatgctgaacctaacagcaaaagtagatgttcagagcaagtcagtttttcgttaaacaatgaagttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagacagagtatctgtagcacagcctggagtgcagtggcgcaatcatgggatagcatgaattttgaggactgttccctcttcgcataagaatagaagtagccatcagagttcatatactttttcaaccctttttcctcaaatacgtatcatttttacttaagtaacttcaattctgtgttttaagctatctaataattgttgtttctactatgttaagatagcctctctacattgttaccctccatccaataaaaaatactgatctga

SEQ ID NO: 419209 - DNA, 863 bp, Homo sapiens
acccccacgaccgaacctggcttcgctaacgccctcccagctccctcgggcctgacttccggtttcctcgcgcgtccctggcgccgagcccgcggacagcggcagccccttttccggctgagagctcatccacacttccaatcactttccggagtgcttcccctccctccggcccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctggttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatggtaagttgatttgaagcgaatga

SEQ ID NO: 419210 - DNA, 794 bp, Homo sapiens
gagcctgggaaggaagagggaacgggtcctggcggtgctttgcaaagggcccgtgtttctgttgcgggaagctcccgggggtcgcacgtgcgtccgagcccaagcccctcccctccactccccttcctgcgtgccccggagccgccaagcggctacgttcttctcggcccgccgagatggcgctcgaccccgcagattttaccaaatgttgcaagaactctggagttcttatggtagtaaaatgccggaaagaaaattctgcattgaaagaatgtctaactgcttactataatgatccagccttttatgaagaatgcaaaatggaatacctgaaggaaagggaagaattcagaaaaactggaattcctacaaagaaaaggctacagaagcttccaacaagcatgtaggcagatactcaaatgacattcaggaactctaatattcatggaagtcattttatagtccttaaataatggactcaagcatatatgtttgctttaccttaattatggaaatattaactttatctgaaataaatattttatttcaaaaaacagacaagaacacacacagcgacaaaaacaaatttgtggcgcgcgcgtcttggcgccctaaaaaaaagagttcaacacacattggggggggggcgcgcggcccagggagtgacgcacaacgcggcaaaggcgtggtcccaagacaccgggcacggcagggggggtcttccaaaaaaaagcgcgcggaacggggttggcaaccaagggtcgggccttgggtcacaggccaggagatccgcg

SEQ ID NO: 419211 - DNA, 638 bp, Homo sapiens
ttggcccctcgaggatactctagagcggccgctcgcgatctagaactagtgttgcgggaagctcccgggggtcgcacgtgcgtccgagcccaagcccctcccctccactccccttcctgcgtgccccggagccgccaagcggctacgttcttctcggcccgccgagatggcgctcgaccccgcagaccagcatctcagacatgtcgaaaaagatgttttgatccctaaaataatgagagaaaaggccaaagagaggtgttctgaacaagttcaagattttaccaaatgttgcaagaactctggagttcttatggtagtaaaatgccggaaagaaaattctgcattgaaagaatgtctaactgcttactataatgatccagccttttatgaagaatgcaaaatggaatacctgaaggaaagggaagaattcagaaaaactggaattcctacaaagaaaaggctacagaagcttccaacaagcatgtaggcagatactcaaatgacattcaggaactctaatattcatggaagtcattttatagtccttaaataatggactcaagcatatatgtttgctttacctaatatatcgccatatacttatctaatattattgcggcgcgcccggggtggcggca

SEQ ID NO: 419212 - DNA, 4680 bp, Homo sapiens
acccccacgaccgaacctggcttcgctaacgccctcccagctccctcgggcctgacttccggtttcctcgcgcgtccctggcgccgagcccgcggacagcggcagccccttttccggctgagagctcatccacacttccaatcactttccggagtgcttcccctccctccggcccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctggttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagtgataatatgcagcatgcatactgggaactgaagagagaaatgtctaatttacatctggtgactcaagtacaagctgaactactaagaaaactgaaaacctcaactgcaatcaagaaagcctgtgcccctgtaggatgcagtgaagaccttggaagagacagcacaaaactgcacttgatgaattttactgcaacatacacaagacatccccctctcttaccaaatggcaaagctctttgtcataccacatcttcccctttaccaggagatgtaaaggttttatcagagaaagcaatcctccaatcatggacagacaatgagagatccattcctaatgatggtacatgctttcaggaacacagttcttatggcagaaattctctggaagacaattcctgggtatttccaagtcctcctaaatcaagtgagacagcatttggggaaactaaaactaaaactttgcctttacccaaccttccaccactgcattacttggatcaacataatcagaactgcctttataagaattaatttggaagagattcacgatttcaccatgaggacacttatctctttcagtggtcctcccaagaaattatttaacaaactgaaaggagattttgattaaaattttgcagaggtcttcagtatctatatttgaacacactgtacaatagtacaaaaaccaacatagttggttttctagtatgaaagagcaccctctagctccatattctaagaatctgaaatatgctactatactaattaataagtaaacttaaggtgtttaaaaaactctgccttctatattaattgtaaaattttgcctctcagaagaatggaattggagattgtagacgtggttttacaaaatgtgaaatgtctaaatatctgttcataaaaataaaaggaaaacatgtttcttcaaattgcataatggaacaaatggcaatgtgagtaggttacatttctgttgttataatgcgtaaagatattgaaaatataatgaaataaaagcatcttaggttataccatctttatatgctattgcgtttcaatatttaagatttaaagtgattttttggtcacagtgttttgttgataaaatttttttagaattgaagtttgaattctaagacttgaaacaacctgatcactgaagccaactttgtcccagcacattccttaagtcctaattgggaaaaaaaaaaaaaaaaatgaaatagttgaaaaactctggggtgtaaacaaatgattgtaaccctacacactattcaataagtagtagaaggagcatcacacagatttcagtctaatctgcccttctgtgggccataatataaacataaatgtgtgtaatgataaaaagtcattttcttcaaagagactacagctagctgcacattgtgtagagcagcttctaaattgttagactttgtgttgaaatgtaatattctatttattgagaaagtgatttaaaattattatttttaatcatagaaatcagggtttgggctgtattgatattgtcgatcatgaaatgtccacacttattctaagtggccaattatttggaaataaagaaggaaataaagatggcttcacatggaaatttaagttctttcagggtggagatttacttggttcatacaccttttgcctgaattaaagtatttcatgtaggaggacttttatcctttttgatagacagtttcatatatcttgaactcaatatctcagatctcttctactgtattactgaatagcatacatacatagacaatgttcgccattcactagatatttttttctattatcttacacttattcaagcttgtctgtgattaatggaattggtgtcagatgctggaatttattctgaccaatgaacacagctgactcaggggagtacaatctcctgccaagtaatagaaccaaacccaatatgcataaaagaaatacaatactccaggctttagctgaaggaagcaactacctgtgtaataacaaagcagcaaaaactatttctcatgtggctgcataggctgtatattatatctgatctctaatgtagcttactggtttgccttttttaaaaccaaaattggaaattttcctttgtaaagaaaaaaagtcttatgagataattgcttgattaatgttttgaacaataccaagaaattgtttaattaaaataaatatttttgtttgaaattgaagtggatgtgaaatattgtccttgcctatagatctcaaaatctagtactaattgttggttgttaatatgattcatacaatagacatttgttaaaccagcttttgagtggagaaaattattttccatttaaacagtacagtgatgatagctatcaaacaggtatactaaaaagtcagtgactgtgacagtttaaagtgttagacaaatgatgtataaggttctttagtaaggaaagattagccaaaaattttttacccagctagaagcttttaaatctacacttgatatctctgttctaggtaaaattcaaacaaccaaaaaacagtggcccatctgtagcttatgaatctatttaaaattgaatattttatgttgacttctttcatactagctgaaacttgctctaaagagcttcctttggaatctttagatttctttttataaggttcaattcagtacatccataaatcgacagaatgaagaaaacataacaaaaagccacctattccttcctcttgctcccttattagctaaagtaaaatttacatctgtaagacttactgagttgctgccaaaatggaactgaattcttaaaagcaggaacgtgcctatgtgaaacattagaaaaccaaaataaatgggaaaattcagacttgaagagctgaatcatgtgacaacaaagtactgatcttaattcagaaaggctacttggagaaggtgtatcttaaggggtaaaaaacctgtgggttaccacatattaacagggaataatatcaacagaggcacccataagcaagcaagacacaactgagacagatgtaccaggtgaaaaaaatcttcagtatggatacacatgggtattctgaaggctacaatgaatggtttagtctttgacataaggaggatgaacatattatttatactgtgtaatctaatctggcttctatggggaaagcaacatgtacataagtgaattttctacatgaagtgggctacttctgattttaatcaaagctataaaatagattgtatatttcactagcttcttaaagtaactcttccattttcatttatctctaaaaacagttaacttcctgtgctctaggaaatgcaccaataccaaaggtcaatgtggaaatatgggcatgtttgcccctatgctgtgtggtctctagatttctatatttgctttgcttttgtctgctctagtaatctccctccttttgatctgtggcctgggaaaatgtggtttctttgtatttcaaataaaagtaaaatagttttttgagtggttcactcaagaaaaaaaaatg

SEQ ID NO: 419213 - DNA, 3453 bp, Homo sapiens
acccccacgaccgaacctggcttcgctaacgccctcccagctccctcgggcctgacttccggtttcctcgcgcgtccctggcgccgagcccgcggacagcggcagccccttttccggctgagagctcatccacacttccaatcactttccggagtgcttcccctccctccggcccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctgggaacctaactctcagagaagtaatgctgaacctaacagcaaaagtagatgttcagagcaagtcagtttttcgttaaacaatgaagttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagtgataatatgcagcatgcatactgggaactgaagagagaaatgtctaatttacatctggtgactcaagtacaagctgaactactaagaaaactgaaaacctcaactgcaatcaagaaagcctgtgcccctgtaggatgcagtgaagaccttggaagagacagcacaaaactgcacttgatgaattttactgcaacatacacaagacatccccctctcttaccaaatggcaaagctctttgtcataccacatcttcccctttaccaggagatgtaaaggttttatcagagaaagcaatcctccaatcatggacagacaatgagagatccattcctaatgatggtacatgctttcaggaacacagttcttatggcagaaattctctggaagacaattcctgggtatttccaagtcctcctaaatcaagtgagacagcatttggggaaactaaaactaaaactttgcctttacccaaccttccaccactgcattacttggatcaacataatcagaactgcctttataagaattaatttggaagagattcacgatttcaccatgaggacacttatctctttcagtggtcctcccaagaaattatttaacaaactgaaaggagattttgattaaaattttgcagaggtcttcagtatctatatttgaacacactgtacaatagtacaaaaaccaacatagttggttttctagtatgaaagagcaccctctagctccatattctaagaatctgaaatatgctactatactaattaataagtaaacttaaggtgtttaaaaaactctgccttctatattaattgtaaaattttgcctctcagaagaatggaattggagattgtagacgtggttttacaaaatgtgaaatgtctaaatatctgttcataaaaataaaaggaaaacatgtttcttcaaattgcataatggaacaaatggcaatgtgagtaggttacatttctgttgttataatgcgtaaagatattgaaaatataatgaaataaaagcatcttaggttataccatctttatatgctattgcgtttcaatatttaagatttaaagtgattttttggtcacagtgttttgttgataaaatttttttagaattgaagtttgaattctaagacttgaaacaacctgatcactgaagccaactttgtcccagcacattccttaagtcctaattgggaaaaaaaaaaaaaaaaatgaaatagttgaaaaactctggggtgtaaacaaatgattgtaaccctacacactattcaataagtagtagaaggagcatcacacagatttcagtctaatctgcccttctgtgggccataatataaacataaatgtgtgtaatgataaaaagtcattttcttcaaagagactacagctagctgcacattgtgtagagcagcttctaaattgttagactttgtgttgaaatgtaatattctatttattgagaaagtgatttaaaattattatttttaatcatagaaatcagggtttgggctgtattgatattgtcgatcatgaaatgtccacacttattctaagtggccaattatttggaaataaagaaggaaataaagatggcttcacatggaaatttaagttctttcagggtggagatttacttggttcatacaccttttgcctgaattaaagtatttcatgtaggaggacttttatcctttttgatagacagtttcatatatcttgaactcaatatctcagatctcttctactgtattactgaatagcatacatacatagacaatgttcgccattcactagatatttttttctattatcttacacttattcaagcttgtctgtgattaatggaattggtgtcagatgctggaatttattctgaccaatgaacacagctgactcaggggagtacaatctcctgccaagtaatagaaccaaacccaatatgcataaaagaaatacaatactccaggctttagctgaaggaagcaactacctgtgtaataacaaagcagcaaaaactatttctcatgtggctgcataggctgtatattatatctgatctctaatgtagcttactggtttgccttttttaaaaccaaaattggaaattttcctttgtaaagaaaaaaagtcttatgagataattgcttgattaatgttttgaacaataccaagaaattgtttaattaaaataaatatttttgtttgaaattgaa

SEQ ID NO: 419214 - DNA, 3147 bp, Homo sapiens
ttggcccctcgaggatactctagagcggccgctcgcgatctagaactagtgttgcgggaagctcccgggggtcgcacgtgcgtccgagcccaagcccctcccctccactccccttcctgcgtgccccggagccgccaagcggctacgttcttctcggcccgccgagatggcgctcgaccccgcagaccagcatctcagacatgtcgaaaaagatgttttgatccctaaaataatgagagaaaaggccaaagagaggtgttctgaacaagttcaagttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagtgataatatgcagcatgcatactgggaactgaagagagaaatgtctaatttacatctggtgactcaagtacaagctgaactactaagaaaactgaaaacctcaactgcaatcaagaaagcctgtgcccctgtaggatgcagtgaagaccttggaagagacagcacaaaactgcacttgatgaattttactgcaacatacacaagacatccccctctcttaccaaatggcaaagctctttgtcataccacatcttcccctttaccaggagatgtaaaggttttatcagagaaagcaatcctccaatcatggacagacaatgagagatccattcctaatgatggtacatgctttcaggaacacagttcttatggcagaaattctctggaagacaattcctgggtatttccaagtcctcctaaatcaagtgagacagcatttggggaaactaaaactaaaactttgcctttacccaaccttccaccactgcattacttggatcaacataatcagaactgcctttataagaattaatttggaagagattcacgatttcaccatgaggacacttatctctttcagtggtcctcccaagaaattatttaacaaactgaaaggagattttgattaaaattttgcagaggtcttcagtatctatatttgaacacactgtacaatagtacaaaaaccaacatagttggttttctagtatgaaagagcaccctctagctccatattctaagaatctgaaatatgctactatactaattaataagtaaacttaaggtgtttaaaaaactctgccttctatattaattgtaaaattttgcctctcagaagaatggaattggagattgtagacgtggttttacaaaatgtgaaatgtctaaatatctgttcataaaaataaaaggaaaacatgtttcttcaaattgcataatggaacaaatggcaatgtgagtaggttacatttctgttgttataatgcgtaaagatattgaaaatataatgaaataaaagcatcttaggttataccatctttatatgctattgcgtttcaatatttaagatttaaagtgattttttggtcacagtgttttgttgataaaatttttttagaattgaagtttgaattctaagacttgaaacaacctgatcactgaagccaactttgtcccagcacattccttaagtcctaattgggaaaaaaaaaaaaaaaaatgaaatagttgaaaaactctggggtgtaaacaaatgattgtaaccctacacactattcaataagtagtagaaggagcatcacacagatttcagtctaatctgcccttctgtgggccataatataaacataaatgtgtgtaatgataaaaagtcattttcttcaaagagactacagctagctgcacattgtgtagagcagcttctaaattgttagactttgtgttgaaatgtaatattctatttattgagaaagtgatttaaaattattatttttaatcatagaaatcagggtttgggctgtattgatattgtcgatcatgaaatgtccacacttattctaagtggccaattatttggaaataaagaaggaaataaagatggcttcacatggaaatttaagttctttcagggtggagatttacttggttcatacaccttttgcctgaattaaagtatttcatgtaggaggacttttatcctttttgatagacagtttcatatatcttgaactcaatatctcagatctcttctactgtattactgaatagcatacatacatagacaatgttcgccattcactagatatttttttctattatcttacacttattcaagcttgtctgtgattaatggaattggtgtcagatgctggaatttattctgaccaatgaacacagctgactcaggggagtacaatctcctgccaagtaatagaaccaaacccaatatgcataaaagaaatacaatactccaggctttagctgaaggaagcaactacctgtgtaataacaaagcagcaaaaactatttctcatgtggctgcataggctgtatattatatctgatctctaatgtagcttactggtttgccttttttaaaaccaaaattggaaattttcctttgtaaagaaaaaaagtcttatgagataattgcttgattaatgttttgaacaataccaagaaattgtttaattaaaataaatatttttgtttgaaattgaa

SEQ ID NO: 419215 - DNA, 2293 bp, Homo sapiens
tcgacggcagagtactcgagttccttgactgaggacatgatgtatataactagtgtaaagactttactttcattgataatatgcagcatgcatactgggaactgaagagagaaatgtctaatttacatctggtgactcaagtacaagctgaactactaagaaaactgaaaacctcaactgcaatcaagaaagcctgtgcccctgtaggatgcagtgaagaccttggaagagacagcacaaaactgcacttgatgaattttactgcaacatacacaagacatccccctctcttaccaaatggcaaagctctttgtcataccacatcttcccctttaccaggagatgtaaaggttttatcagagaaagcaatcctccaatcatggacagacaatgagagatccattcctaatgatggtacatgctttcaggaacacagttcttatggcagaaattctctggaagacaattcctgggtatttccaagtcctcctaaatcaagtgagacagcatttggggaaactaaaactaaaactttgcctttacccaaccttccaccactgcattacttggatcaacataatcagaactgcctttataagaattaatttggaagagattcacgatttcaccatgaggacacttatctctttcagtggtcctcccaagaaattatttaacaaactgaaaggagattttgattaaaattttgcagaggtcttcagtatctatatttgaacacactgtacaatagtacaaaaaccaacatagttggttttctagtatgaaagagcaccctctagctccatattctaagaatctgaaatatgctactatactaattaataagtaaacttaaggtgtttaaaaaactctgccttctatattaattgtaaaattttgcctctcagaagaatggaattggagattgtagacgtggttttacaaaatgtgaaatgtctaaatatctgttcataaaaataaaaggaaaacatgtttcttcaaattgcataatggaacaaatggcaatgtgagtaggttacatttctgttgttataatgcgtaaagatattgaaaatataatgaaataaaagcatcttaggttataccatctttatatgctattgcgtttcaatatttaagatttaaagtgattttttggtcacagtgttttgttgataaaatttttttagaattgaagtttgaattctaagacttgaaacaacctgatcactgaagccaactttgtcccagcacattccttaagtcctaattgggaaaaaaaaaaaaaaaaatgaaatagttgaaaaactctggggtgtaaacaaatgattgtaaccctacacactattcaataagtagtagaaggagcatcacacagatttcagtctaatctgcccttctgtgggccataatataaacataaatgtgtgtaatgataaaaagtcattttcttcaaagagactacagctagctgcacattgtgtagagcagcttctaaattgttagactttgtgttgaaatgtaatattctatttattgagaaagtgatttaaaattattatttttaatcatagaaatcagggtttgggctgtattgatattgtcgatcatgaaatgtccacacttattctaagtggccaattatttggaaataaagaaggaaataaagatggcttcacatggaaatttaagttctttcagggtggagatttacttggttcatacaccttttgcctgaattaaagtatttcatgtaggaggacttttatcctttttgatagacagtttcatatatcttgaactcaatatctcagatctcttctactgtattactgaatagcatacatacatagacaatgttcgccattcactagatatttttttctattatcttacacttattcaagcttgtctgtgattaatggaattggtgtcagatgctggaatttattctgaccaatgaacacagctgactcaggggagtacaatctcctgccaagtaatagaaccaaacccaatatgcataaaagaaatacaatactccaggctttagctgaaggaagcaactacctgtgtaataacaaagcagcaaaaactatttctcatgtggctgcataggctgtatattatatctgatctctaatgtagcttactggtttgccttttttaaaaccaaaattggaaattttcctttgtaaagaaaaaaagtcttatgagataattgcttgattaatgttttgaacaataccaagaaattgtttaattaaaataaatatttttgtttgaaattgaa

SEQ ID NO: 419216 - DNA, 751 bp, Homo sapiens
gagcctgggaaggaagagggaacgggtcctggcggtgctttgcaaagggcccgtgtttctgttgcgggaagctcccgggggtcgcacgtgcgtccgagcccaagcccctcccctccactccccttcctgcgtgccccggagccgccaagcggctacgttcttctcggcccgccgagatggcgctcgaccccgcagaccagcatctcagacatgtcgaaaaagatgttttgatccctaaaataatgagagaaaaggccaaagagaggtgttctgaacaagttcaagattttaccaaatgttgcaagaactctggagttcttatggtagtaaaatgccggaaagaaaattctgcattgaaagaatgtctaactgcttaataactgaatgaaaatatctctgagacttcctccagccttgtgatttgttggattaatataatttaactcctagaaagttgagataaatcgtatggatgataaaaagctataatgatccagccttttatgaagaatgcaaaatggaatacctgaaggaaagggaagaattcagaaaaactggaattcctacaaagaaaaggctacagaagcttccaacaagcatgtaggcagatactcaaatgacattcaggaactctaatattcatggaagtcattttatagtccttaaataatggactcaagcatatatgtttgctttaccttaattatggaaatattaactttatctgaaataaatattttatttcaaaaaa

SEQ ID NO: 419217 - DNA, 1021 bp, Homo sapiens
acccccacgaccgaacctggcttcgctaacgccctcccagctccctcgggcctgacttccggtttcctcgcgcgtccctggcgccgagcccgcggacagcggcagccccttttccggctgagagctcatccacacttccaatcactttccggagtgcttcccctccctccggcccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctggttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaaggtaatttttatcttttaccttcattgcgtttgtgacataaggaataattcaaaatacttgaaattttgaatactttttgtcctgtcttccatgattgtactaaatttccaagaataactcactgctaatctgaaaactctgggcattatacttatcctgtgtttcacataccatgtacttggtaaatatttgtaggagaggatttaacaacttggagttatattccaaatatttttctttcattttcaggtttacttacctccatagctgtatgtattttattcagaattttcaaatctgggca

SEQ ID NO: 419218 - DNA, 3389 bp, Homo sapiens
agcagaggaagccgaggggcggcatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttatgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419219 - DNA, 2677 bp, Homo sapiens
  misc_feature (944)..(944): n is a, c, g, or t
  misc_feature (1879)..(1879): n is a, c, g, or t
gagttggagtcttgctctgtcacccaggctggagtgcagtggcatgatctcagctcactgcaacctccaggaggtgttgtaatttagcagttgggaagtaattgggagatttgaattctagctaccaattcaactataatggattggaaaacaagatttctgtgttagtttaacagaggagagctaaaaaagaactcaggcctgaatggttgtcaggaatttacttgggtgactatcttctcatctcagaacataaaatgtaggaattaccacagttgcaaagggagatgtttatgttggagataaaaatgctcctcccttcaaaaatgagacagtattttagataggaaaggttatttatctgattacatgttttaaaattctgagcgtaaggttatatgtcaaatcctgtccatgggctgggcacagtggcccacacctgtgatcctagcactttggaaggctgagggggaggattgattgagcccaggaggtcaaggctacagtgaactatgatcacaccactgcacttcaacctgggcagcagagcgagaccctgtctcaaaaaataaaaataaattaacaaaaaaatctggtccatgtccatctcctcttagctgctaattcaattttagattagacacagtggacaaggacaagtatggtgagagtcctgtgatttctcaccagcttcctttccacataggccactgcttctcttcttccaaggtttttccccgcttttgcctcctggaggttgtatcctgggtgttaggagactgggttccggacacattccccacagaaggatagcaggaccttagaagatctttttctttcttttcctggtttcctcttgtttgcaagagggttgaataggatggtctctaaaatcctgttgtttttctgggttatattaacccaggccataatgataagaaccngctctgaattcacaacatgtatttatacaacagcaatttaatatttcttattctgtggaatggctaggaagctctgctggtcttggttggatggttttttgtttgtttttttttgagacagggtctcgctttgtcgcccaggctggagtgcagtgacgccatcagctctctgcaacctccacttcccaggctcaagtgattctcttgctcagcctcccgagtagctgggactacagacacatgctactgcacccagctaatttctgtatttttagtagagatggggtttcaccatgttgcccaggctggtctcgacctcctgagctcaagtgatccacccaccttggtttcccaaagtgctgggattacaggtgtgagccaccgtgctcggctggtttttcttaaggtctcacctgggttcacttgtgtggctgaattcagctggtggtttggcaggggctggatgcagttacaacagaggatctgtctctttaaataactacccttcatccccaaagaggccagaccagctccttcacagtgctccaagagagcaagccatgacgcccaagcattttatccagcctctgcttgcttcagtttgctaaggtcccactggccaaagcagattacatggccaggtctaatgtcaatatgaagggggcactccacaaaagcgtgaacatgtaaggcatgactcatgagggtcactaatgtaatagtcaccacaacctccatgctaagttacctatattctccagtgaggatttctcaaggtggttttgttcatagtcttctaatagaattatttggaattatcagtttaatatgcttatgatgtatttcactggaaccatacaggttttgattcgcagagttgggagccctgggtagatactgaatcagactaagtttaatcacagaaattattcctncgtaagtctgatcttatgttttcaagatagcattgtaaaattcagagtatgttaccatccccctttgagacctctgctgtttttaataaatggaagcatttgggaatactatttggtaatagtttattaaaactacttcagagatattctggactttcatattagtcttagatatggattaataaacattagcaatgaatctgttatctaagagaaaaatttaaatttatattacaacagtggaatataatgtttaataacttgtgttggggggattatgtgttttgtttgtttttttttttagctcttcagagaagtaagaataatgaagattttaaatcatcccaatataggtactttctgcttttttaaatattttggggtctaaatacgtacttgaaattatgtcataaagctaaacacgtattctagaaatggtagagtacacttctagtaaaatatatatacaagttgttgatcatttgtattagctttttgaaattgctgaagacaggttaaaagcttaggtattaaacgttgaatttaaagctttaatctggtagaaacatctgtactctgattataattttctaatttttaagtatattagaaaatataattgtattgcatgagtagatagaagggaattataggaagtcagaattaatattttcaaaggggctgggcacagtggctcatgcctgtaattccagcactttgggaaaccaaggcaggaggattgctggaggtcaggagctcaagaccagcctaagcaacagagcgagaccccgtctctcc

SEQ ID NO: 419220 - DNA, 854 bp, Homo sapiens
  misc_feature (556)..(556): n is a, c, g, or t
  misc_feature (563)..(563): n is a, c, g, or t
  misc_feature (568)..(568): n is a, c, g, or t
  misc_feature (573)..(573): n is a, c, g, or t
  misc_feature (588)..(589): n is a, c, g, or t
aaataagttgtattaagatagtagaaataggctggattacaggtgtgagcccccacgtccggccttttttgtgtcttctttaagaaattcttctctacctggggtcataaacatatttttctctgttgtcttcacatgtttaaagtaatctttaagccaccagcagtcatgtgttacgaggtagggatccagtttcatggtttttcgtatgtataatcacttgctgcctcacctctcctttctttgctgatctgcatcgtggacagagtctccgtgtctaaacgcacactttgttcttcagaagtggttattctggttcacttaacaattgccatttgaaaagcaattatttttattttattttcatatttttaaattttatttttaatgataggacaccaaatgataaccagaaccccaaaatacataggtgaaaatctgagctaaattaatagaaacacaggcatgacagagaagactttatcacttaactctcttaggccattcattaattacacagtaagtagggggaaaaggtacatatcttaatatcacnacacgcntgccnattanttttatgaatgaggnntgatgatggggctgtctgtgccagatgatgtacagcagcttacgcctgagctggatcttggtaagacttccccagccctaggtactgctaaggggcacaccgctagaccgtttaattggaggccatggcactggaaatgacgcgaaaaaaaagagttttgggggctctgggtttgcgcggtagggggctgccttaggacctcggaaggcgcttcctgcgccgcgcggtgcagacgcgttttcggaaggccaagggcttgggacct

SEQ ID NO: 419221 - DNA, 3437 bp, Homo sapiens
agcagaggaagccgaggggcggcatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttatgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419222 - DNA, 3559 bp, Homo sapiens
agcagaggaagccgaggggcggcatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttatgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaaaaacaaaacaacaacaacacacacacacaaccgccaaccctccaccccaccggcgcggagcccaatctcgccgcgcgggcgccttctcgccctttcccgcgcccctacggactccaccactc

SEQ ID NO: 419223 - DNA, 3684 bp, Homo sapiens
agcagaggaagccgaggggcggcatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttatgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaacaaggctaaaaaaacaaactaacttacataaactaaaccttctgggcgcgccttatatgtcccgcgggccgcgcgcacaccagggcttatcttgaaatgtccgcccgtgcggcctcaaaagccgtgtcccgataacccccacgttttttgtgttcccacacgggggcacacttcgccggggcccccatttaggggagcccgcaaataatttccgagtaacccgggttacctggttgactccgccaca

SEQ ID NO: 419224 - DNA, 3866 bp, Homo sapiens
agcagaggaagccgaggggcggcatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttatgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggtataagaagctgcacccatgtacttcactaaactaaaagaagtttcctaatattacatggcttaatatttttaacattatatcagtgcggggggtttcagggggttttttgttgtgtttggttaactaaacctaaaggttgacttactcgttttctttcctctgtacctctccaaaggaactgagagagagagtattaagagggaaatacagaattcccttctacatgtctacagactgtgaaaaccttctcaaacgtttcctggtgctaaatccaattaaacgcggcactctagaggtaatcatgtaggtggaaacaagcagtaactttggagagtctttagagtgaccttagatctttgcttgatttgtatgccatactggatatatcctgcggctttttaagcaagaattgaaacattaaaaaatattttttgagtttatgctttgaacgatagtcaatgaaatgttgaaaataaatttttgtaaatattacggttatcagaatatttcattttactctgctaatgaacagtttaccttttttagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419225 - DNA, 3482 bp, Homo sapiens
agcagaggaagccgaggggcggcatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttatgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggaggcttccaactgaatatgagaggaacgggagatatgagggctcaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419226 - DNA, 4680 bp, Homo sapiens
  misc_feature (944)..(944): n is a, c, g, or t
  misc_feature (1879)..(1879): n is a, c, g, or t
gagttggagtcttgctctgtcacccaggctggagtgcagtggcatgatctcagctcactgcaacctccaggaggtgttgtaatttagcagttgggaagtaattgggagatttgaattctagctaccaattcaactataatggattggaaaacaagatttctgtgttagtttaacagaggagagctaaaaaagaactcaggcctgaatggttgtcaggaatttacttgggtgactatcttctcatctcagaacataaaatgtaggaattaccacagttgcaaagggagatgtttatgttggagataaaaatgctcctcccttcaaaaatgagacagtattttagataggaaaggttatttatctgattacatgttttaaaattctgagcgtaaggttatatgtcaaatcctgtccatgggctgggcacagtggcccacacctgtgatcctagcactttggaaggctgagggggaggattgattgagcccaggaggtcaaggctacagtgaactatgatcacaccactgcacttcaacctgggcagcagagcgagaccctgtctcaaaaaataaaaataaattaacaaaaaaatctggtccatgtccatctcctcttagctgctaattcaattttagattagacacagtggacaaggacaagtatggtgagagtcctgtgatttctcaccagcttcctttccacataggccactgcttctcttcttccaaggtttttccccgcttttgcctcctggaggttgtatcctgggtgttaggagactgggttccggacacattccccacagaaggatagcaggaccttagaagatctttttctttcttttcctggtttcctcttgtttgcaagagggttgaataggatggtctctaaaatcctgttgtttttctgggttatattaacccaggccataatgataagaaccngctctgaattcacaacatgtatttatacaacagcaatttaatatttcttattctgtggaatggctaggaagctctgctggtcttggttggatggttttttgtttgtttttttttgagacagggtctcgctttgtcgcccaggctggagtgcagtgacgccatcagctctctgcaacctccacttcccaggctcaagtgattctcttgctcagcctcccgagtagctgggactacagacacatgctactgcacccagctaatttctgtatttttagtagagatggggtttcaccatgttgcccaggctggtctcgacctcctgagctcaagtgatccacccaccttggtttcccaaagtgctgggattacaggtgtgagccaccgtgctcggctggtttttcttaaggtctcacctgggttcacttgtgtggctgaattcagctggtggtttggcaggggctggatgcagttacaacagaggatctgtctctttaaataactacccttcatccccaaagaggccagaccagctccttcacagtgctccaagagagcaagccatgacgcccaagcattttatccagcctctgcttgcttcagtttgctaaggtcccactggccaaagcagattacatggccaggtctaatgtcaatatgaagggggcactccacaaaagcgtgaacatgtaaggcatgactcatgagggtcactaatgtaatagtcaccacaacctccatgctaagttacctatattctccagtgaggatttctcaaggtggttttgttcatagtcttctaatagaattatttggaattatcagtttaatatgcttatgatgtatttcactggaaccatacaggttttgattcgcagagttgggagccctgggtagatactgaatcagactaagtttaatcacagaaattattcctncgtaagtctgatcttatgttttcaagatagcattgtaaaattcagagtatgttaccatccccctttgagacctctgctgtttttaataaatggaagcatttgggaatactatttggtaatagtttattaaaactacttcagagatattctggactttcatattagtcttagatatggattaataaacattagcaatgaatctgttatctaagagaaaaatttaaatttatattacaacagtggaatataatgtttaataacttgtgttggggggattatgtgttttgtttgtttttttttttagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419227 - DNA, 2772 bp, Homo sapiens
gttccaacagttattagagtactagattgagtgagcaggaaggtagaagaagttagttaaagaatgggaagctcaaacttggatcatgaaaggttttcagatattgggaatgtcaaagactggagtataaccatgttgcaataaaaataattgacaaaactcagttgaatccaacaagtctacaaaagtagagacggggtttcaccgtgttatccaggatggtctcgatctcctgacctcgtgatccacccatcttggcttcccaaagtgctggactcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419228 - DNA, 3523 bp, Homo sapiens
  misc_feature (722)..(722): n is a, c, g, or t
caaaaatgtgtcttcatagcttgaaagacatcccaggaaagaagtgaacagatgggctatgatgtaaaacaaggagacctacttagatacgttttcagagaatctgcctgagacttaaaggatgaaaagggagaagacatttaaaggaatttagtatgttctgtgccaccgtgctcggctggtttttcttaaggtctcacctgggttcacttgtgtggctgaattcagctggtggtttggcaggggctggatgcagttacaacagaggatctgtctctttaaataactacccttcatccccaaagaggccagaccagctccttcacagtgctccaagagagcaagccatgacgcccaagcattttatccagcctctgcttgcttcagtttgctaaggtcccactggccaaagcagattacatggccaggtctaatgtcaatatgaagggggcactccacaaaagcgtgaacatgtaaggcatgactcatgagggtcactaatgtaatagtcaccacaacctccatgctaagttacctatattctccagtgaggatttctcaaggtggttttgttcatagtcttctaatagaattatttggaattatcagtttaatatgcttatgatgtatttcactggaaccatacaggttttgattcgcagagttgggagccctgggtagatactgaatcagactaagtttaatcacagaaattattcctncgtaagtctgatcttatgttttcaagatagcattgtaaaattcagagtatgttaccatccccctttgagacctctgctgtttttaataaatggaagcatttgggaatactatttggtaatagtttattaaaactacttcagagatattctggactttcatattagtcttagatatggattaataaacattagcaatgaatctgttatctaagagaaaaatttaaatttatattacaacagtggaatataatgtttaataacttgtgttggggggattatgtgttttgtttgtttttttttttagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419229 - DNA, 2414 bp, Homo sapiens
ccgagggtccagacgcagcacctgagctcttccagggcaagaaatatgacgggccagaagtggatgtgtggaggaaagcttttctaaaatgcctaatcctgtcataattctaattctattttggctaaatttcatttttgtcttgatgttttccctctaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419230 - DNA, 3509 bp, Homo sapiens
agcagaggaagccgaggggcggcatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttatgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagaaacatgtcattcaggtttatcaaaaggcttccaactgaatatgagaggaacgggagatatgagggctcaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419231 - DNA, 3461 bp, Homo sapiens
agcagaggaagccgaggggcggcatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttatgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagaaacatgtcattcaggtttatcaaaaggcttccaactgaatatgagaggaacgggagatatgagggctcaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419232 - DNA, 2003 bp, Homo sapiens
aacctggtctttcataaattaacctgtagtcattaatagcttagaaatgacgtaaagcatcagatgaagtaaatacaacatttaaagttatttgagaaagcctggaaagaaaatcataaataccttacctttagtgtctttccagccgtcagaaaactacttttgcttgagtttagggttgtcatttttgtacgttgtgattcctcctctctctgaatgaacggtttatgagaggtctgtgttaatgaaaagtttaacttcctaataagccatttgggttcgtgttgtggtttgctctgtttttctcattttctcttagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419233 - DNA, 1872 bp, Homo sapiens
aaaaatgcacattctttgtgaaactaatgtgtacccactgcttcttaattttgtgctgtggattttatagtctgagattttgttacagttgtccacaaggcgtccttcctccatgtgattttagttaagcacatcttttgtcatgatgtcctcggttgtgtattgtgtgtcttcgtgccttcgcgtactacaaaatgtataagaagttcctgctcctcccaagttgctttcagcatgtggaattttatacatatatcatttgtttacttccaaaactttttagttgcctgttcttcagttacgccagcatatcctttatttctttcgtattggcacagttctctatgtaagcaatttgagagggaagcaaaggggaaaagtttgagttagctgttctctgtcctagaatttccctgcattaatcttgtccttgaaaatatatataatactggtcccttaaactccatgaggctttgtctcattatgtattgttcttttggtaccctttcccacttaacttaccttttgctcctaagtcctataaaataccccttggatctggattttttatacccgattttctccactgtgtataaaaggtatattgtgactgtaaatttttgtatatcatgttctgagagcttcttactttctgatctcatagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419234 - DNA, 1244 bp, Homo sapiens
ctgaggctgcttcatggtgctggcgctgcatcatggtgacttggattcttgtgaaaagagtttaggtaccttgtattcctcaatccgttccctccctgggctaccaggattatgcagcctctgcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419235 - DNA, 3383 bp, Homo sapiens
agcagaggaagccgaggggcggcatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttatgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccacaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419236 - DNA, 1423 bp, Homo sapiens
tggcttttaattggaaacccattatactgtgtggcacaattagaaagtgagaataaccccattctgaggccgagtgtgctcaggctgaagagccagcaggagtgcccgctgtgcgtgcgtggtgtgcggtgtgtgcagcagtgtgtgcagtgtgcagcgtgcagcggtatggcatgcaatgtgtgtgatgtatgcagtgtgcagcatggagctggcccctgtgcacacccctgcagccttgtggaagaaggtagcgctggctcagtcaaatgagaggaagagttttcataagcccggctggtgtttaaaacgtgttttggctttgttcattttatggtgttggtgttggtattggtggtcatgtactggcatgtaagatttcttttctctttccctcttctctctgcttctacattctgttcattgaggcttccaactgaatatgagaggaacgggagatatgagggctcaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419237 - DNA, 1993 bp, Homo sapiens
agcttctctcatcagtattggtggatgtgaaccaaattgaatactggcaggttggtgacacggagagctatgtgcatatgcaaaagctgtagcccctcacctctggttagttggccataggatggagtgtacttaaggtacatagactattttactcccaagaatgctaggcactcactgtcttaattgaggccaccagatacacacatgagaatataaataacggcttgtggcaataatgactaaatgccaaggagtggctggtaaaccgcggtgttccctagagaccccggcctgggctctacttaggctgcctcttggacatcagaccaaggcttacattctgaatccacagggcatccacatgggtggtgtcagtcccccacagacagagaagtgtcccgttgcatttttccatctattccagtagtaagattgtgtcatttgagattttctttaactgtataattggacgtttaattaacaaaccagagaggaggaaaaacaatgaggtgggtagagcatcatgttcagcctcagggctgtacagcaaagcaattttagactgcggatgttgagtctccagttaccctgagtgccagttacagtgattcacatctgaaagaacagtactgcaggagagggacagcccagggtggatgggtggggtgggcaggagctggctgccaactccttccctgagctgggcctgcagagccctgaggagtggggcatgctgtcctttttgcctgatttccaaggattctgcttaacgaattacttcgttcattttagtaagcacaggtggctggtgaagattttccagctaggtagatctttttgtgtgtggcttatgacttttagggggtgagggaagaaaatagacgaaaatagacttagttacaaatgtgagtctgtgcaggaaaatgtggaggtcagtcgttagttgtgttgtatcaaagacgtgaatgaggaactagctgaagtgtaagaggttgattttcctgtacgattaaaaataaacctgcctctatgcatttcagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419238 - DNA, 3021 bp, Homo sapiens
agcagaggaagccgaggggcggcatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttatgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgctgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419239 - DNA, 2697 bp, Homo sapiens
agcagaggaagccgaggggcggcatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttatgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaa

SEQ ID NO: 419240 - DNA, 2247 bp, Homo sapiens
agcagaggaagccgaggggcggcatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttatgttttgaccctcgcattgtgcagaattaaagtgcagtaaaatgtccactaggaccccattgccaacggtgaatgaacgagacactgaaaaccacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggttgcaataaaaataattgacaaaactcagttgaatccaacaagtctacaaaagctcttcagagaagtaagaataatgaagattttaaatcatcccaatatagtgaagttattcgaagtcattgaaactgaaaaaacactctacctaatcatggaatatgcaagtggaggtgaagtatttgactatttggttgcacatggcaggatgaaggaaaaagaagcaagatctaaatttagacagattgtgtctgcagttcaatactgccatcagaaacggatcgtacatcgagacctcaaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggaactgagagagagagtattaagagggaaatacagaattcccttctacatgtctacagactgtgaaaaccttctcaaacgtttcctggtgctaaatccaattaaacgcggcactctagagcaaatcatgaaggacaggtggatcaatgcagggcatgaagaagatgaactcaaaccatttgttgaaccagagctagacatctcagaccaaaaaagaatagatattatggtgggaatgggatattcacaagaagaaattcaagaatctcttagtaagatgaaatacgatgaaatcacagctacatatttgttattggggagaaaatcttcagaggtaagagtaatcagaaagagctgaaataccctgtatgtaattattagtttatataaactgttttcttagtttttatcttttgaatatttgtaacatttgatacatcattttttagatttacttgcaaatagcaaatctaaatcctatgactattataagctattttaacttaacccttaatgatggatattggccaggcgtggtggctcatgcctgtaatcccagcactttgggaggccaaggcggacagatcacttgagaccaggagttcgagaccagactggccaacatagggaaactctgtctctgctaaaacaaacaaacaaacaaaaaattagctgggcgtgttggcgcttgcctgtaatccctgctccttgggaggctgaggcaagagaactgcttgaccctgagaggcagaggttgcggtgagccaggatcacgccactgcactccagcctgggtgacagagcgagactctgtctcaaaaaaaaaaa

SEQ ID NO: 419241 - DNA, 450 bp, Homo sapiens
attgtgtctgcagttcaatactgccatcagaaacggatcgtacatcgagacctcaaggtgagtagaagtgcctcactcagtgtatgctctgtctgtttgtgtgcagttctctcagtggtcattacacaaatgaggtatagattagccttattagcattttttaaaatcccacaataattgaatcctcttaatcaagttatgggaaagagcattaaaaataaagaaaaataaaggttattgaaagtattttacatttcagttacggtgactggtggttgatctctggagaacagtcatcacacagccaaacaaatgtgggcctccagaaatgtatggtcacgcccacagcatcctcagtgccacccggcattcatttctgctgctttcatcagtattctctcccgttaacagcagtgcctgtttgagacctctttcaaggtcctcagcctc

SEQ ID NO: 419242 - DNA, 366 bp, Homo sapiens
aagcagtaactttggagagtctttagagtgaccttagatctttgcttgatttgtatgccatactggatatatcctgcggctttttaagcaagaattgaaacattaaaaaatattttttgagtttatgctttgaacgatagtcaatgaaatgttgaaaataaatttttgtaaatattacggttatcagaatatttcattttactctgctaatgaacagtttaccttttttagcaaatcatgaaggacaggtggatcaatgcagggcatgaagaagatgaactcaaaccatttgttgaaccagagctagacatctcagaccaaaaaagaataggtaatcactccatgcctgcatgttcatgtgttttt

SEQ ID NO: 419243 - DNA, 1527 bp, Homo sapiens
cgcaaaagtagttgatggaaatcggccgttgggatgctgtctaagcttggatacctgagtaataacggacaacagataaagctccgcatccttgcgccacgtgcttcggtccgtggtttgcgtgcagacgtttgacctgtatggtgaccctcgcgatttgcaaatgtgctgaggatctggaatactgaagtggaaggcacctcttgttttggggagcatgtatatttccctcctgtgacgcactgcttccacagagaggtgcaaacgtgcaaacgctcagcgaccgcagcgctcctgcccctcccccaccgtaactccggggtcgcggatctgcccgccccgctctcccgaagctgttcgggcagtgtccgaacggcttcggaggggcgagaagccagcatccgagccgcctctccggaataccagcagcctgacgcacgcgtgctgtcgggggagggatgctgggacagctgctcccgcacacggctcgcggtctcggcgccgcggagatgcccggccaggtccggggtccgactggacggagcgtagctcttctgcagagccgcccgctgtggccgggaccgagggtggcggcggcggatcagctggatactcttgttaccagaattccaaaggttctgatagaatcaaagatggatacaaagtgaactcacacatagctaagctgcaagagttatggaaaactccccaaaatcaaacaatccacctctctaaatcaatgatggaggcgtcctttttcaagcatccagacctcaccacaggccagaagcgttacctgtgcagcattgctaaaatctataatgcaaactatctgaagatgttaatgaagaggcagtacatgcacgtacttcagcacagctcacaaaagccaggtgtcctcactcatcacagaagccgccttagctcccgttactcacagaaacagcattacccttgcactacatggcgacatcaactggagagagaggactcggggtcttctgatatcgcagctgcatctgcacctgaaatgctcatacagcattccctttggcggccagtgagaaacaaagaagggataaaaactggatatgcatctaaaacaagatgtaagtcactgaagatttttagaagaccaaggaaactgttcatgcaaacagtttcttcagatgattctgaatcacacatgagtgaagaaaaaaaggaagaagatttactaaataattttatgcaatcaatgtcaattgaagaacagggagaacatctgatgttaacttgacagtcttgtctcgtgtattgaattcgtgccaaaggtgagggtaaggggttgtgagttgtgtcctgtatgtttaggatggtattgttatttattaaatcattaagtaattttggtttgttcagaaacttaaaacaatgtaattggtctgatgtagttccatgtaccaatgatagttatgtaagaaaatttacatgtaacatatacttgtacttctagctagatacaattaaaacttttcttgcattcaa

SEQ ID NO: 419244 - DNA, 2091 bp, Homo sapiens
cgcaaaagtagttgatggaaatcggccgttgggatgctgtctaagcttggatacctgagtaataacggacaacagataaagctccgcatccttgcgccacgtgcttcggtccgtggtttgcgtgcagacgtttgacctgtatggtgaccctcgcgatttgcaaatgtgctgaggatctggaatactgaagtggaaggcacctcttgttttggggagcatgtatatttccctcctgtgacgcactgcttccacagagaggtgcaaacgtgcaaacgctcagcgaccgcagcgctcctgcccctcccccaccgtaactccggggtcgcggatctgcccgccccgctctcccgaagctgttcgggcagtgtccgaacggcttcggaggggcgagaagccagcatccgagccgcctctccggaataccagcagcctgacgcacgcgtgctgtcgggggagggatgctgggacagctgctcccgcacacggctcgcggtctcggcgccgcggagatgcccggccaggtccggggtccgactggacggagcgtagctcttctgcagagccgcccgctgtggccgggaccgagggtggcggcggcggatcagctggatactcttgttaccagaattccaaaggttctgatagaatcaaagatggatacaaagtgaactcacacatagctaagctgcaagagttatggaaaactccccaaaatcaaacaatccacctctctaaatcaatgatggaggcgtcctttttcaagcatccagacctcaccacaggccagaagcgttacctgtgcagcattgctaaaatctataatgcaaactatctgaagatgttaatgaagaggcagtacatgcacgtacttcagcacagctcacaaaagccaggtgtcctcactcatcacagaagccgccttagctcccgttactcacagaaacagcattacccttgcactacatggcgacatcaactggagagagaggactcggggtcttctgatatcgcagctgcatctgcacctgaaatgctcatacagcattccctttggcggccagtgagaaacaaagaagggataaaaactggatatgcatctaaaacaagatgtaagtcactgaagatttttagaagaccaaggaaactgttcatgcaaacagtttcttcagatgattctgaatcacacatgagtgaagaaaaaaaggaagaagatttactaaataattttatgcaatcaatgtcaattgaagaacagggagaacatctgatgttaacttgacagtcttgtctcgtgtattgaattcgtgccaaaggtgagggtaaggggttgtgagttgtgtcctgtatgtttaggatggtattgttatttattaaatcattaagtaattttggtttgttcagaaacttaaaacaatgtaattggtctgatgtagttccatgtaccaatgatagttatgtaagaaaatttacatgtaacatatacttgtacttctagctagatacaattaaaacttttcttgcattcaaaaaaaaaaccaataaagaggacaaccaaacaaacaacaaacaacatcaaccggggaggcactactgagggggggcggcaacaagcgagagtactgaggaaaaggcacgttggggccaaacggtggtctccccgggccccacctctgtgttgacacacagaggagacaaactcggcgagaccccccattacagggaagtcgaaataattacggaaagccacggtgatccgctgatgataagacaaccgggcaaacggacataacagactgagacatgccgaaaggcgacgacaagaagacgagagcaggagacaagaacaaagagacggagaacgacgaactggtaggaggagagagagagggcgacaggcacagagagggcgcaacggaaagagacggacataagacgaaacaaaacgtcggagaggaaggagggcggaggagacaagaggaaggaggagacagagaagcgggagaagaacgacaggaggcggaaacgaaacggggcagggcgcacggaagaaataaaacgaaaaaagacaaccaaacgcgagaagaagacaaa

SEQ ID NO: 419245 - DNA, 1133 bp, Homo sapiens
  misc_feature (12)..(12): n is a, c, g, or t
atagctctttgngtgacacctaatttagaaaccccgcctcggggcttttttataaaaaaaagccagtgtacgccgaatccggatcgcaccggctcgcggtctcggcgccgcggagatgcccggccaggtccggggtccgactggacggagcgtagctcttctgcagagccgcccgctgtggccgggaccgagggtggcggcggcggatcagctggatactcttgttaccagaattccaaaggttctgatagaatcaaagatggatacaaagtgaactcacacatagctaagctgcaagagttatggaaaactccccaaaatcaaacaatccacctctctaaatcaatgatggaggcgtcctttttcaagcatccagacctcaccacaggccagaagcgttacctgtgcagcattgctaaaatctataatgcaaactatctgaagatgttaatgaagaggcagtacatgcacgtacttcagcacagctcacaaaagccaggtgtcctcactcatcacagaagccgccttagctcccgttactcacagaaacagcattacccttgcactacatggcgacatcaactggagagagaggactcggggtcttctgatatcgcagctgcatctgcacctgaaatgctcatacagcattccctttggcggccagtgagaaacaaagaagggataaaaactggatatgcatctaaaacaagatgtaagtcactgaagatttttagaagaccaaggaaactgttcatgcaaacagtttcttcagatgattctgaatcacacatgagtgaagaaaaaaaggaagaagatttactaaataattttatgcaatcaatgtcaattgaagaacagggagaacatctgatgttaacttgacagtcttgtctcgtgtattgaattcgtgccaaaggtgagggtaaggggttgtgagttgtgtcctgtatgtttaggatggtattgttatttattaaatcattaagtaattttggtttgttcagaaacttaaaacaatgtaattggtctgatgtagttccatgtaccaatgatagttatgtaagaaaatttacatgtaacatatacttgtacttctagctagatacaattaaaacttttcttgcattcaa

SEQ ID NO: 419246 - DNA, 1385 bp, Homo sapiens
cagtgcgacatgaacgaagggaaaaaagcggggaagctaatagacgagtacacgaaaagggtggtagggagaggatgacaaggggatcaacacggtaggatgcgcaggctagatggaagagtcagagcgtcggggacaaattcagcgcgagacgcccacaggaagtaggagagtctcaaggctgcagcggacagacctgacgccgacacgcgaagtctcagacatggggcgtccatgagacacgcatctcgaagacagccaggaatacaggtatagtcacacaccggccgaggtccatagatcagcccgtaagtccagcacttcgagagccgacggcggagtatcatgagggtcaggagatccaacccacctcggcctcccaaagtgctgggattacaggcgtgagccaccacacccggcctaaatatctagatcttaataattcagtttgttgaactgatctttgcctctgaaattcacatgatgtctttgcctacagatagaatcaaagatggatacaaagtgaactcacacatagctaagctgcaagagttatggaaaactccccaaaatcaaacaatccacctctctaaatcaatgatggaggcgtcctttttcaagcatccagacctcaccacaggccagaagcgttacctgtgcagcattgctaaaatctataatgcaaactatctgaagatgttaatgaagaggcagtacatgcacgtacttcagcacagctcacaaaagccaggtgtcctcactcatcacagaagccgccttagctcccgttactcacagaaacagcattacccttgcactacatggcgacatcaactggagagagaggactcggggtcttctgatatcgcagctgcatctgcacctgaaatgctcatacagcattccctttggcggccagtgagaaacaaagaagggataaaaactggatatgcatctaaaacaagatgtaagtcactgaagatttttagaagaccaaggaaactgttcatgcaaacagtttcttcagatgattctgaatcacacatgagtgaagaaaaaaaggaagaagatttactaaataattttatgcaatcaatgtcaattgaagaacagggagaacatctgatgttaacttgacagtcttgtctcgtgtattgaattcgtgccaaaggtgagggtaaggggttgtgagttgtgtcctgtatgtttaggatggtattgttatttattaaatcattaagtaattttggtttgttcagaaacttaaaacaatgtaattggtctgatgtagttccatgtaccaatgatagttatgtaagaaaatttacatgtaacatatacttgtacttctagctagatacaattaaaacttttcttgcattcaa

SEQ ID NO: 419247 - DNA, 1473 bp, Homo sapiens
cgcaaaagtagttgatggaaatcggccgttgggatgctgtctaagcttggatacctgagtaataacggacaacagataaagctccgcatccttgcgccacgtgcttcggtccgtggtttgcgtgcagacgtttgacctgtatggtgaccctcgcgatttgcaaatgtgctgaggatctggaatactgaagtggaaggcacctcttgttttggggagcatgtatatttccctcctgtgacgcactgcttccacagagaggtgcaaacgtgcaaacgctcagcgaccgcagcgctcctgcccctcccccaccgtaactccggggtcgcggatctgcccgccccgctctcccgaagctgttcgggcagtgtccgaacggcttcggaggggcgagaagccagcatccgagccgcctctccggaataccagcagcctgacgcacgcgtgctgtcgggggagggatgctgggacagctgctcccgcacacggctcgcggtctcggcgccgcggagatgcccggccaggtccggggtccgactggacggagcgtagctcttctgcagagccgcccgctgtggccgggaccgagggtggcggcggcggatcagctggatactcttgttaccagaattccaaaggttctgatagaatcaaagatggatacaaagtgaactcacacatagctaagctgcaagagttatggaaaactccccaaaatcaaacaatccacctctctaaatcaatgatggaggcgtcctttttcaagcatccagacctcaccacaggccagaagcgttacctgtgcagcattgctaaaatctataatgcaaactatctgaagatgttaatgaagaggcagtacatgcacgtacttcagcacagctcacaaaagccaggtgtcctcactcatcacagaagccgccttagctcccgttactcacagaaacagcattacccttgcactacatggcgacatcaactggagagagaggactcggggtcttctgatatcgcagctgcatctgcacctgaaatgctcatacagcattccctttggcggccagtgagaaacaaagaagggataaaaactggatatgcatctaaaacaagatgtaagtcactgaagatttttagaagaccaaggaaactgttcatgcaaacagtttcttcagatgattctgaatcacacatgagtgaagaaaagggagaacatctgatgttaacttgacagtcttgtctcgtgtattgaattcgtgccaaaggtgagggtaaggggttgtgagttgtgtcctgtatgtttaggatggtattgttatttattaaatcattaagtaattttggtttgttcagaaacttaaaacaatgtaattggtctgatgtagttccatgtaccaatgatagttatgtaagaaaatttacatgtaacatatacttgtacttctagctagatacaattaaaacttttcttgcattcaa

SEQ ID NO: 419248 - DNA, 806 bp, Homo sapiens
  misc_feature (37)..(37): n is a, c, g, or t
gctgggtgactctagagttccccggatgggcgacatntcaagcatccagacctcaccacaggccagaagcgttacctgtgcagcattgctaaaatctataatgcaaactatctgaagatgttaatgaagaggcagtacatgcacgtacttcagcacagctcacaaaagccaggtgtcctcactcatcacagaagccgccttagctcccgttactcacagaaacagcattacccttgcactacatggcgacatcaactggagagagaggactcggggtcttctgatatcgcagctgcatctgcacctgaaatgctcatacagcattccctttggcggccagtgagaaacaaagaagggataaaaactggatatgcatctaaaacaagatgtaagtcactgaagatttttagaagaccaaggaaactgttcatgcaaacagtttcttcagatgattctgaatcacacatgagtgaagaaaaaaaggaagaagatttactaaataattttatgcaatcaatgtcaattgaagaacagggagaacatctgatgttaacttgacagtcttgtctcgtgtattgaattcgtgccaaaggtgagggtaaggggttgtgagttgtgtcctgtatgtttaggatggtattgttatttattaaatcattaagtaattttggtttgttcagaaacttaaaacaatgtaattggtctgatgtagttccatgtaccaatgatagttatgtaagaaaatttacatgtaacatatacttgtacttctagctagatacaattaaaacttttcttgcattcaa

SEQ ID NO: 419249 - DNA, 1295 bp, Homo sapiens
cgcaaaagtagttgatggaaatcggccgttgggatgctgtctaagcttggatacctgagtaataacggacaacagataaagctccgcatccttgcgccacgtgcttcggtccgtggtttgcgtgcagacgtttgacctgtatggtgaccctcgcgatttgcaaatgtgctgaggatctggaatactgaagtggaaggcacctcttgttttggggagcatgtatatttccctcctgtgacgcactgcttccacagagaggtgcaaacgtgcaaacgctcagcgaccgcagcgctcctgcccctcccccaccgtaactccggggtcgcggatctgcccgccccgctctcccgaagctgttcgggcagtgtccgaacggcttcggaggggcgagaagccagcatccgagccgcctctccggaataccagcagcctgacgcacgcgtgctgtcgggggagggatgctgggacagctgctcccgcacacggctcgcggtctcggcgccgcggagatgcccggccaggtccggggtccgactggacggagcgtagctcttctgcagagccgcccgctgtggccgggaccgagggtggcggcggcggatcagctggatactcttgttaccagaattccaaaggttctgatagaatcaaagatggatacaaagtgaactcacacatagctaagctgcaagagttatggaaaactccccaaaatcaaacaatccacctctctaaatcaatgatggaggcgtcctttttcaagcatccagacctcaccacaggccagaagcgttacctgtgcagcattgctaaaatctataatgcaaactatctgaagatgttaatgaagaggcagtacatgcacgtacttcagcacagctcacaaaagccaggtgtcctcactcatcacagaagccgccttagctcccgttactcacagaaacagcattacccttgcactacatggcgacatcaactggagagagaggactcggggtcttctgatatcgcagctgcatctgcacctgaaatgctcatacagcattccctttggcggccagtgagaaacaaagaagggtctgtttcttagtgtaaaaggggggaaatgcatctcagtttaatttttttttttctcagacagggttttgttctctcacccaggctggagtgtagtggtgtgatacagtttactgtattctcaaactcctgggctcaagcaatgctcctgcctcagactcccaagtagctagggctaaaggcacaaaccaccatgccctgctagttaaaaaaaattg

SEQ ID NO: 419250 - DNA, 1175 bp, Homo sapiens
agcgttgccctggagagcccctctgtccctgctatccccatctcccctggcccagacttctgcccttcacgcccatccctgaccagcagccccactcagtctgggctctgggtgccagctggttatagacatgccacctgaacccaggccaggagctggtggatgcgtggggctattttaagcacagcctcttggcctgcacactcccctggcccccagcccccagcagctcagctactggtcacctgccaccgcctggaatgctgattggcagttggctggggtgggtgggggctgggaagacactattataaagctgggagtgttgggaagcagccgtccccgtccagagtcctctgtggtccctgctgccaccatggccactcaccgcctcgtgatggtccggcacggcgagagcacatggaaccaggagaaccgtttctgtggctggttcgatgcagagctgagtgaaaaggggaccgaggaggccaagcggggagccaaggccatcaaggatgccaagatggagtttgacatctgctacacgtcagtgctgaagcgggccatccgcaccctctgggccatcctggacggcacggaccagatgtggctgcctgtggtgcgcacttggcgcctcaatgagcggcattacgggggcctcacaggcctcaacaaggcagaaacggccgccaagcacggggaggagcaggtgaagatctggaggcgctccttcgacatcccgccgcccccgatggacgagaagcacccctactacaactccattagcaaggagcgtcggtacgcaggcctgaagcccggggaactccccacctgcgagagcctcaaggacaccattgcccgggccctgcccttctggaacgaggagattgttccccagatcaaggccggcaagcgagtgctcattgcagcccacgggaacagcctgcggggcattgtcaagcacctggaagggatgtcagaccaggcgatcatggagctgaacctgcccacggggatccccattgtgtatgagctgaacaaggagctgaagcccaccaagcccatgcagttcctgggtgatgaggaaacggtgcggaaggccatggaggctgtggctgcccagggcaaggccaagtgaggggtgggcttgggcaataaaggcacctcccccaaca

SEQ ID NO: 419251 - DNA, 1291 bp, Homo sapiens
agcgttgccctggagagcccctctgtccctgctatccccatctcccctggcccagacttctgcccttcacgcccatccctgaccagcagccccactcagtctgggctctgggtgccagctggttatagacatgccacctgaacccaggccaggagctggtggatgcgtggggctattttaagcacagcctcttggcctgcacactcccctggcccccagcccccagcagctcagctactggtcacctgccaccgcctggaatgctgattggcagttggctggggtgggtgggggctgggaagacactattataaagctgggagtgttgggaagcagccgtccccgtccagagtcctctgtggtccctgctgccaccatggccactcaccgcctcgtgatggtccggcacggcgagagcacatggaaccaggagaaccgtttctgtggctggttcgatgcagagctgagtgaaaaggggaccgaggaggccaagcggggagccaaggccatcaaggatgccaagatggagtttgacatctgctacacgtcagtgctgaagcgggccatccgcaccctctgggccatcctggacggcacggaccagatgtggctgcctgtggtgcgcacttggcgcctcaatgagcggcattacgggggcctcacaggcctcaacaaggcagaaacggccgccaagcacggggaggagcaggtgaagatctggaggcgctccttcgacatcccgccgcccccgatggacgagaagcacccctactacaactccattagcaaggagcgtcggtacgcaggcctgaagcccggggaactccccacctgcgagagcctcaaggacaccattgcccgggccctgcccttctggaacgaggagattgttccccagatcaaggccggcaagcgagtgctcattgcagcccacgggaacagcctgcggggcattgtcaagcacctggaagggatgtcagaccaggcgatcatggagctgaacctgcccacggggatccccattgtgtatgagctgaacaaggagctgaagcccaccaagcccatgcagttcctgggtgatgaggaaacggtgcggaaggccatggaggctgtggctgcccagggcaaggccaagtgaggggtgggcttgggcaataaaggcacctcccccaacaaaaaagaatatcttgatatttggttaaatagaagtctaagattaaaaaacctgagggggggcccggttcccattttgccttttgggaggcgtttttcccgcgctaagtggcctagg

SEQ ID NO: 419252 - DNA, 994 bp, Homo sapiens
agcgttgccctggagagcccctctgtccctgctatccccatctcccctggcccagacttctgcccttcacgcccatccctgaccagcagccccactcagtctgggctctgggtgccagctggttatagacatgccacctgaacccaggccaggagctggtggatgcgtggggctattttaagcacagcctcttggcctgcacactcccctggcccccagcccccagcagctcagctactggtcacctgccaccgcctggaatgctgattggcagttggctggggtgggtgggggctgggaagacactattataaagctgggagtgttgggaagcagccgtccccgtccagagtcctctgtggtccctgctgccaccatggccactcaccgcctcgtgatggtccggcacggcgagagcacatggaaccaggagaaccgtttctgtggctggttcgatgcagagctgagtgaaaaggggaccgaggaggccaagcggggagccaaggccatcaaggatgccaagatggagtttgacatctgctacacgtcagtgctgaagcgggccatccgcaccctctgggccatcctggacggcacggaccagatgtggctgcctgtggtgcgcacttggcgcctcaatgagcggcattacgggggcctcacaggcctcaacaaggcagaaacggccgccaagcacggggaggagcaggtgaagatctggaggcgctccttcgacatcccgccgcccccgatggacgagaagcacccctactacaactccattagcaagggatgtcagaccaggcgatcatggagctgaacctgcccacggggatccccattgtgtatgagctgaacaaggagctgaagcccaccaagcccatgcagttcctgggtgatgaggaaacggtgcggaaggccatggaggctgtggctgcccagggcaaggccaagtgaggggtgggcttgggcaataaaggcacctcccccaaca

SEQ ID NO: 419253 - DNA, 645 bp, Homo sapiens
tggagatggagtttcgctcttgtcgctcaggttggagtgcaatggcacaataggagtaaaactccatctcaaaaaaaagaaaaagaaaaagaaaagaaaaaaaaaaaacaaagggtgagtgtcccttcctgaccctcaacttcagtctggctggagtcacactgggctgagggaactagtggacagcaccaccacagatcacagccacttgggtgggctgaagtccccatttttttcaccactgggctatttctgtaggctgcttggtctaactcagttactccttgacctttggcaacatttctgtggcctcgttctcagggctgggaaggaattggtgccaggggaactggctctgtggaccataaaggtcacatagtgtctgctgtgtaaacaggctggggacagaggggctaaggacacctattccttccggcatagggatgtcagaccaggcgatcatggagctgaacctgcccacggggatccccattgtgtatgagctgaacaaggagctgaagcccaccaagcccatgcagttcctgggtgatgaggaaacggtgcggaaggccatggaggctgtggctgcccagggcaaggccaagtgaggggtgggcttgggcaataaaggcacctcccccaaca

SEQ ID NO: 419254 - DNA, 1279 bp, Homo sapiens
agcgttgccctggagagcccctctgtccctgctatccccatctcccctggcccagacttctgcccttcacgcccatccctgaccagcagccccactcagtctgggctctgggtgccagctggttatagacatgccacctgaacccaggccaggagctggtggatgcgtggggctattttaagcacagcctcttggcctgcacactcccctggcccccagcccccagcagctcagctactggtcacctgccaccgcctggaatgctgattggcagttggctggggtgggtgggggctgggaagacactattataaagctgggagtgttgggaagcagccgtccccgtccagagtcctctgtggtccctgctgccaccatggccactcaccgcctcgtgatggtccggcacggcgagagcacatggaaccaggagaaccgtttctgtggctggttcgatgcagagctgagtgaaaaggggaccgaggaggccaagcggggagccaaggccatcaaggatgccaagatggagtttgacatctgctacacgtcagtgctgaagcgggccatccgcaccctctgggccatcctggacggcacggaccagatgtggctgcctgtggtgcgcacttggcgcctcaatgagcggcattacgggggcctcacaggcctcaacaaggcagaaacggccgccaagcacggggaggagcaggtgaagatctggaggcgctccttcgacatcccgccgcccccgatggacgagaagcacccctactacaactccattagcaaggtgggctgcctttgctgggaaggcctctgggaagctgcagagtggggagtcgggtgggggcccactggcttgggagggaaagcagcgtgcctgtgtccccgcaggagcgtcggtacgcaggcctgaagcccggggaactccccacctgcgagagcctcaaggacaccattgcccgggccctgcccttctggaacgaggagattgttccccagatcaaggccggcaagcgagtgctcattgcagcccacgggaacagcctgcggggcattgtcaagcacctggaagggatgtcagaccaggcgatcatggagctgaacctgcccacggggatccccattgtgtatgagctgaacaaggagctgaagcccaccaagcccatgcagttcctgggtgatgaggaaacggtgcggaaggccatggaggctgtggctgcccagggcaaggccaagtgaggggtgggcttgggcaataaaggcacctcccccaaca

SEQ ID NO: 419255 - DNA, 1106 bp, Homo sapiens
agcgttgccctggagagcccctctgtccctgctatccccatctcccctggcccagacttctgcccttcacgcccatccctgaccagcagccccactcagtctgggctctgggtgccagctggttatagacatgccacctgaacccaggccaggagctggtggatgcgtggggctattttaagcacagcctcttggcctgcacactcccctggcccccagcccccagcagctcagctactggtcacctgccaccgcctggaatgctgattggcagttggctggggtgggtgggggctgggaagacactattataaagctgggagtgttgggaagcagccgtccccgtccagagtcctctgtggtccctgctgccaccatggccactcaccgcctcgtgatggtccggcacggcgagagcacatggaaccaggagaaccgtttctgtggctggttcgatgcagagctgagtgaaaaggggaccgaggaggccaagcggggagccaaggccatcaaggatgccaagatggagtttgacatctgctacacgtcagtgctgaagcgggccatccgcaccctctgggccatcctggacggcacggaccagatgtggctgcctgtggtgcgcacttggcgcctcaatgagcggcattacgggggcctcacaggcctcaacaaggcagaaacggccgccaagcacggggaggagcaggtgaagatctggaggcgctccttcgacatcccgccgcccccgatggacgagaagcacccctactacaactccattagcaaggagcgtcggtacgcaggcctgaagcccggggaactccccacctgcgagagcctcaaggacaccattgcagcccacgggaacagcctgcggggcattgtcaagcacctggaagggatgtcagaccaggcgatcatggagctgaacctgcccacggggatccccattgtgtatgagctgaacaaggagctgaagcccaccaagcccatgcagttcctgggtgatgaggaaacggtgcggaaggccatggaggctgtggctgcccagggcaaggccaagtgaggggtgggcttgggcaataaaggcacctcccccaaca

SEQ ID NO: 419256 - DNA, 813 bp, Homo sapiens
tggagatggagtttcgctcttgtcgctcaggttggagtgcaatggcacaataggagtaaaactccatctcaaaaaaaagaaaaagaaaaagaaaagaaaaaaaaaaaacaaagggtgagtgtcccttcctgaccctcaacttcagtctggctggagtcacactgggctgagggaactagtggacagcaccaccacagatcacagccacttgggtgggctgaagtccccatttttttcaccactgggctatttctgtaggctgcttggtctaactcagttactccttgacctttggcaacatttctgtggcctcgttctcagggctgggaaggaattggtgccaggggaactggctctgtggaccataaaggtcacatagtgtctgctgtgtaaacaggctggggacagaggggctaaggacacctattccttccggcatagggatgtcagaccaggcgatcatggagctgaacctgcccacggggatccccattgtgtatgagctgaacaaggagctgaagcccaccaagcccatgcagttcctgggtgatgaggaaacggtgcggaaggccatggaggctgtggctgcccagggcaaggccaagtgaggggtgggcttgggcaataaaggcacctcccccaacagcctgggagtccagcgcaccgttgcattgccaggctcacaccgccatcagctgtggggattccagaaccaggggttgcagccacccaccctcccccactccatacgtgtgtcaccaggggcaggagcctagtacccacacctagtcatcaggacactgagccagggct

SEQ ID NO: 419257 - DNA, 717 bp, Homo sapiens
attcggaacgaggcctcgtgcgcactcgtgccgcctcgtgccgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccgtggaaatagcctggctccctcttacccagtaatgaggggcagggaagggaactgggaggcagccgtttagtcctccctgccctgcccactgcctggatggggcgatgccacccctcatccttcacccagctctggcctctgggtcccaccacccagccccccgtgtcagaacaatctttgctctgtacaatcggcctctttacaataaaacctcctgctccacaaaaaaaaac

SEQ ID NO: 419258 - DNA, 399 bp, Homo sapiens
tttggcagagcgacgggaggagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggttcagttcttttgttccacggagaacagacatgccctgcccctcttcacctccctcctcaacaccgtgtgtgcctatgaccctatgaatgtgtaatacggaacccagtgagtgccagccgcagtgacccagtcctcctgatctcctcccgtcgtctgccaaagtatctgccgtc

SEQ ID NO: 419259 - DNA, 3346 bp, Homo sapiens
ggcggggccgacgagggccgggggcggggcgcgccgcttgtctcctgcgagagccgcgggggccgcggagctggagccggagctgaagccggagccgggttggagtctgggcgggggccgggccggagcgggctccagagacatggggtcgaccgactccaagctgaacttccggaaggcggtgatccagctcaccaccaagacgcagcccgtggaagccaccgatgatgccttttgggaccagttctgggcagacacagccacctcggtgcaggatgtgtttgcactggtgccggcagcagagatccgggccgtgcgggaagagtcaccctccaacttggccaccctgtgctacaaggccgttgagaagctggtgcagggagctgagagtggctgccactcggagaaggagaagcagatcgtcctgaactgcagccggctgctcacccgcgtgctgccctacatctttgaggaccccgactggaggggcttcttctggtccacagtgcccggggcagggcgaggagggcagggagaagaggatgatgagcatgccaggcccctggccgagtccctgctcctggccattgctgacctgctcttctgcccggacttcacggttcagagccaccggaggagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggttcagttcttttgttccacggagaacagacatgccctgcccctcttcacctccctcctcaacaccgtgtgtgcctatgaccctgtgggctacgggatcccctacaaccacctgctcttctctgactaccgggaacccctggtggaggaggctgcccaggtgctcattgtcactttggaccacgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactccaccaagaagatccagttccaccaggagctgctagttctcttctggaagctctgcgacttcaacaagaaattcctcttcttcgtgctgaagagcagcgacgtcctagacatccttgtccccatcctcttcttcctcaacgatgcccgggccgatcagtctcgggtgggcctgatgcacattggtgtcttcatcttgctgcttctgagcggggagcggaacttcggggtgcggctgaacaaaccctactcaatccgcgtgcccatggacatcccagtcttcacagggacccacgccgacctgctcattgtggtgttccacaagatcatcaccagcgggcaccagcggttgcagcccctcttcgactgcctgctcaccatcgtggtcaacgtgtccccctacctcaagagcctgtccatggtgaccgccaacaagttgctgcacctgctggaggccttctccaccacctggttcctcttctctgccgcccagaaccaccacctggtcttcttcctcctggaggtcttcaacaacatcatccagtaccagtttgatggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcatcgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtgaggatgaagccgacgaggggctcagtctaggggaaggcagggccttggtccctgaggcttcccccatccaccattctgagctttaaattaccacgatcagggcctggaacaggcagagtggccctgagtgtcatgccctagagacccctgtggccaggacaatgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccgtggaaatagcctggctccctcttacccagtaatgaggggcagggaagggaactgggaggcagccgtttagtcctccctgccctgcccactgcctggatggggcgatgccacccctcatccttcacccagctctggcctctgggtcccaccacccagccccccgtgtcagaacaatctttgctctgtacaatcggcctctttacaataaaacctcctgctccacaaaaaaaaac

SEQ ID NO: 419260 - DNA, 3540 bp, Homo sapiens
ggcggggccgacgagggccgggggcggggcgcgccgcttgtctcctgcgagagccgcgggggccgcggagctggagccggagctgaagccggagccgggttggagtctgggcgggggccgggccggagcgggctccagagacatggggtcgaccgactccaagctgaacttccggaaggcggtgatccagctcaccaccaagacgcagcccgtggaagccaccgatgatgccttttgggaccagttctgggcagacacagccacctcggtgcaggatgtgtttgcactggtgccggcagcagagatccgggccgtgcgggaagagtcaccctccaacttggccaccctgtgctacaaggccgttgagaagctggtgcagggagctgagagtggctgccactcggagaaggagaagcagatcgtcctgaactgcagccggctgctcacccgcgtgctgccctacatctttgaggaccccgactggaggggcttcttctggtccacagtgcccggggcagggcgaggagggcagggagaagaggatgatgagcatgccaggcccctggccgagtccctgctcctggccattgctgacctgctcttctgcccggacttcacggttcagagccaccggaggagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggttcagttcttttgttccacggagaacagacatgccctgcccctcttcacctccctcctcaacaccgtgtgtgcctatgaccctgtgggctacgggatcccctacaaccacctgctcttctctgactaccgggaacccctggtggaggaggctgcccaggtgctcattgtcactttggaccacgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactccaccaagaagatccagttccaccaggagctgctagttctcttctggaagctctgcgacttcaacaagaaattcctcttcttcgtgctgaagagcagcgacgtcctagacatccttgtccccatcctcttcttcctcaacgatgcccgggccgatcagtgtaagaccagggtgggggtgggatgctgggggctttcctggcggcgaggtggagggctggctatctgccctgactcccaggagctcaggcctggcactctgacctcctaggagggaggcctccaaaatggtcactgcctgggcccctccttccccctcccacccgagtgacccctcccacgccacctgccgcagctcgggtgggcctgatgcacattggtgtcttcatcttgctgcttctgagcggggagcggaacttcggggtgcggctgaacaaaccctactcaatccgcgtgcccatggacatcccagtcttcacagggacccacgccgacctgctcattgtggtgttccacaagatcatcaccagcgggcaccagcggttgcagcccctcttcgactgcctgctcaccatcgtggtcaacgtgtccccctacctcaagagcctgtccatggtgaccgccaacaagttgctgcacctgctggaggccttctccaccacctggttcctcttctctgccgcccagaaccaccacctggtcttcttcctcctggaggtcttcaacaacatcatccagtaccagtttgatggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcatcgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtgaggatgaagccgacgaggggctcagtctaggggaaggcagggccttggtccctgaggcttcccccatccaccattctgagctttaaattaccacgatcagggcctggaacaggcagagtggccctgagtgtcatgccctagagacccctgtggccaggacaatgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccgtggaaatagcctggctccctcttacccagtaatgaggggcagggaagggaactgggaggcagccgtttagtcctccctgccctgcccactgcctggatggggcgatgccacccctcatccttcacccagctctggcctctgggtcccaccacccagccccccgtgtcagaacaatctttgctctgtacaatcggcctctttacaataaaacctcctgctccacaaaaaaaaac

SEQ ID NO: 419261 - DNA, 3617 bp, Homo sapiens
ggcggggccgacgagggccgggggcggggcgcgccgcttgtctcctgcgagagccgcgggggccgcggagctggagccggagctgaagccggagccgggttggagtctgggcgggggccgggccggagcgggctccagagacatggggtcgaccgactccaagctgaacttccggaaggcggtgatccagctcaccaccaagacgcagcccgtggaagccaccgatgatgccttttgggaccagttctgggcagacacagccacctcggtgcaggatgtgtttgcactggtgccggcagcagagatccgggccgtgcgggaagagtcaccctccaacttggccaccctgtgctacaaggccgttgagaagctggtgcagggagctgagagtggctgccactcggagaaggagaagcagatcgtcctgaactgcagccggctgctcacccgcgtgctgccctacatctttgaggaccccgactggaggggcttcttctggtccacagtgcccggggcagggcgaggagggcagggagaagaggatgatgagcatgccaggcccctggccgagtccctgctcctggccattgctgacctgctcttctgcccggacttcacggttcagagccaccggaggagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggttcagttcttttgttccacggagaacagacatgccctgcccctcttcacctccctcctcaacaccgtgtgtgcctatgaccctgtgggctacgggatcccctacaaccacctgctcttctctgactaccgggaacccctggtggaggaggctgcccaggtgctcattgtcactttggaccacgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactccaccaagaagatccagttccaccaggagctgctagttctcttctggaagctctgcgacttcaacaagaaattcctcttcttcgtgctgaagagcagcgacgtcctagacatccttgtccccatcctcttcttcctcaacgatgcccgggccgatcagtctcgggtgggcctgatgcacattggtgtcttcatcttgctgcttctgagcggggagcggaacttcggggtgcggctgaacaaaccctactcaatccgcgtgcccatggacatcccagtcttcacagggacccacgccgacctgctcattgtggtgttccacaagatcatcaccagcgggcaccagcggttgcagcccctcttcgactgcctgctcaccatcgtggtcaacgtgtccccctacctcaagagcctgtccatggtgaccgccaacaagttgctgcacctgctggaggccttctccaccacctggttcctcttctctgccgcccagaaccaccacctggtcttcttcctcctggaggtcttcaacaacatcatccagtaccagtttgatggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcatcgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggtgggccccggggagtggggtggtgtccacctgagagcctgcccagcagggctcaacagggacctcagctctgggccccaccacctatggtggacttcatgtcaagacagtcaactaaggcggccttgcctggttgacggtggcacccgctgcccagggtgggacatcgggatggaaagggttggcttggccattcctgctgcccagctcctcctggtgccttgtctgcaaggtgccccagcacctgggtaaccccccatttcctccacaggaatgtggacccccctgtctggtacgacaccgacgtgaagctgtttgagatacagcgggtgtgaggatgaagccgacgaggggctcagtctaggggaaggcagggccttggtccctgaggcttcccccatccaccattctgagctttaaattaccacgatcagggcctggaacaggcagagtggccctgagtgtcatgccctagagacccctgtggccaggacaatgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccgtggaaatagcctggctccctcttacccagtaatgaggggcagggaagggaactgggaggcagccgtttagtcctccctgccctgcccactgcctggatggggcgatgccacccctcatccttcacccagctctggcctctgggtcccaccacccagccccccgtgtcagaacaatctttgctctgtacaatcggcctctttacaataaaacctcctgctccacaaaaaaaaac

SEQ ID NO: 419262 - DNA, 3419 bp, Homo sapiens
ggcggggccgacgagggccgggggcggggcgcgccgcttgtctcctgcgagagccgcgggggccgcggagctggagccggagctgaagccggagccgggttggagtctgggcgggggccgggccggagcgggctccagagacatggggtcgaccgactccaagctgaacttccggaaggcggtgatccagctcaccaccaagacgcagcccgtggaagccaccgatgatgccttttgggaccagttctgggcagacacagccacctcggtgcaggatgtgtttgcactggtgccggcagcagagatccgggccgtgcgggaagagtcaccctccaacttggccaccctgtgctacaaggccgttgagaagctggtgcagggagctgagagtggctgccactcggagaaggagaagcagatcgtcctgaactgcagccggctgctcacccgcgtgctgccctacatctttgaggaccccgactggaggggcttcttctggtccacagtgcccggggcagggcgaggagggcagggagaagaggatgatgagcatgccaggcccctggccgagtccctgctcctggccattgctgacctgctcttctgcccggacttcacggttcagagccaccggaggagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggttcagttcttttgttccacggagaacagacatgccctgcccctcttcacctccctcctcaacaccgtgtgtgcctatgaccctgtgggctacgggatcccctacaaccacctgctcttctctgactaccgggaacccctggtggaggaggctgcccaggtgctcattgtcactttggaccacgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactccaccaagaagatccagttccaccaggagctgctagttctcttctggaagctctgcgacttcaacaagaaattcctcttcttcgtgctgaagagcagcgacgtcctagacatccttgtccccatcctcttcttcctcaacgatgcccgggccgatcagtctcgggtgggcctgatgcacattggtgtcttcatcttgctgcttctgagcggggagcggaacttcggggtgcggctgaacaaaccctactcaatccgcgtgcccatggacatcccagtcttcacagggacccacgccgacctgctcattgtggtgttccacaagatcatcaccagcgggcaccagcggttgcagcccctcttcgactgcctgctcaccatcgtggtcaacgtgtccccctacctcaagagcctgtccatggtgaccgccaacaagttgctgcacctgctggaggccttctccaccacctggttcctcttctctgccgcccagaaccaccacctggtcttcttcctcctggaggtcttcaacaacatcatccagtaccagtttgatggaagcccacccagattggacggggggagctggagggggcctccctgaggcgaaggcatgctccctgcccacaggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcatcgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtgaggatgaagccgacgaggggctcagtctaggggaaggcagggccttggtccctgaggcttcccccatccaccattctgagctttaaattaccacgatcagggcctggaacaggcagagtggccctgagtgtcatgccctagagacccctgtggccaggacaatgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccgtggaaatagcctggctccctcttacccagtaatgaggggcagggaagggaactgggaggcagccgtttagtcctccctgccctgcccactgcctggatggggcgatgccacccctcatccttcacccagctctggcctctgggtcccaccacccagccccccgtgtcagaacaatctttgctctgtacaatcggcctctttacaataaaacctcctgctccacaaaaaaaaac

SEQ ID NO: 419263 - DNA, 3163 bp, Homo sapiens
ggcggggccgacgagggccgggggcggggcgcgccgcttgtctcctgcgagagccgcgggggccgcggagctggagccggagctgaagccggagccgggttggagtctgggcgggggccgggccggagcgggctccagagacatggggtcgaccgactccaagctgaacttccggaaggcggtgatccagctcaccaccaagacgcagcccgtggaagccaccgatgatgccttttgggaccagttctgggcagacacagccacctcggtgcaggatgtgtttgcactggtgccggcagcagagatccgggccgtgcgggaagagtcaccctccaacttggccaccctgtgctacaaggccgttgagaagctggtgcagggagctgagagtggctgccactcggagaaggagaagcagatcgtcctgaactgcagccggctgctcacccgcgtgctgccctacatctttgaggaccccgactggaggggcttcttctggtccacagtgcccggggcagggcgaggagggcagggagaagaggatgatgagcatgccaggcccctggccgagtccctgctcctggccattgctgacctgctcttctgcccggacttcacggttcagagccaccggaggagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggttcagttcttttgttccacggagaacagacatgccctgcccctcttcacctccctcctcaacaccgtgtgtgcctatgaccctgtgggctacgggatcccctacaaccacctgctcttctctgactaccgggaacccctggtggaggaggctgcccaggtgctcattgtcactttggaccacgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactccaccaagaagatccagttccaccaggagctgctagttctcttctggaagctctgcgacttcaacaagaaattcctcttcttcgtgctgaagagcagcgacgtcctagacatccttgtccccatcctcttcttcctcaacgatgcccgggccgatcagtctcgggtgggcctgatgcacattggtgtcttcatcttgctgcttctgagcggggagcggaacttcggggtgcggctgaacaaaccctactcaatccgcgtgcccatggacatcccagtcttcacagggacccacgccgacctgctcattgtggtgttccacaagatcatcaccagcgggcaccagcggttgcagcccctcttcgactgcctgctcaccatcgtggtcaacgtgtccccctacctcaagagcctgtccatggtgaccgccaacaagttgctgcacctgctggaggccttctccaccacctggttcctcttctctgccgcccagaaccaccacctggtcttcttcctcctggaggtcttcaacaacatcatccagtaccagtttgatggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcatcgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtgaggatgaagccgacgaggggctcagtctaggggaaggcagggccttggtccctgaggcttcccccatccaccattctgagctttaaattaccacgatcagggcctggaacaggcagagtggccctgagtgtcatgccctagagacccctgtggccaggacaatgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccgtggaaatagcctggctccctcttacccagtaatgaggggcagggaagggaactgggaggcagccgtttagtcctccctgccctgcccactgcctggatggggcgatgccacccctcatccttcacccagctctggcctctgggtcccaccacccagccccccgtgtcagaacaatctttgctctgtacaatcggcctctttacaataaaacctcctgctccacaaaaaaaaac

SEQ ID NO: 419264 - DNA, 3025 bp, Homo sapiens
ggcggggccgacgagggccgggggcggggcgcgccgcttgtctcctgcgagagccgcgggggccgcggagctggagccggagctgaagccggagccgggttggagtctgggcgggggccgggccggagcgggctccagagacatggggtcgaccgactccaagctgaacttccggaaggcggtgatccagctcaccaccaagacgcagcagggagaagaggatgatgagcatgccaggcccctggccgagtccctgctcctggccattgctgacctgctcttctgcccggacttcacggttcagagccaccggaggagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggttcagttcttttgttccacggagaacagacatgccctgcccctcttcacctccctcctcaacaccgtgtgtgcctatgaccctgtgggctacgggatcccctacaaccacctgctcttctctgactaccgggaacccctggtggaggaggctgcccaggtgctcattgtcactttggaccacgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactccaccaagaagatccagttccaccaggagctgctagttctcttctggaagctctgcgacttcaacaagaaattcctcttcttcgtgctgaagagcagcgacgtcctagacatccttgtccccatcctcttcttcctcaacgatgcccgggccgatcagtctcgggtgggcctgatgcacattggtgtcttcatcttgctgcttctgagcggggagcggaacttcggggtgcggctgaacaaaccctactcaatccgcgtgcccatggacatcccagtcttcacagggacccacgccgacctgctcattgtggtgttccacaagatcatcaccagcgggcaccagcggttgcagcccctcttcgactgcctgctcaccatcgtggtcaacgtgtccccctacctcaagagcctgtccatggtgaccgccaacaagttgctgcacctgctggaggccttctccaccacctggttcctcttctctgccgcccagaaccaccacctggtcttcttcctcctggaggtcttcaacaacatcatccagtaccagtttgatggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcatcgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtgaggatgaagccgacgaggggctcagtctaggggaaggcagggccttggtccctgaggcttcccccatccaccattctgagctttaaattaccacgatcagggcctggaacaggcagagtggccctgagtgtcatgccctagagacccctgtggccaggacaatgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccgtggaaatagcctggctccctcttacccagtaatgaggggcagggaagggaactgggaggcagccgtttagtcctccctgccctgcccactgcctggatggggcgatgccacccctcatccttcacccagctctggcctctgggtcccaccacccagccccccgtgtcagaacaatctttgctctgtacaatcggcctctttacaataaaacctcctgctccacaaaaaaaaac

SEQ ID NO: 419265 - DNA, 2663 bp, Homo sapiens
ggcggggccgacgagggccgggggcggggcgcgccgcttgtctcctgcgagagccgcgggggccgcggagctggagccggagctgaagccggagccgggttggagtctgggcgggggccgggccggagcgggctccagagacatggggtcgaccgactccaagctgaacttccggaaggcggtgatccagctcaccaccaagacgcagctccctcctcaacaccgtgtgtgcctatgaccctgtgggctacgggatcccctacaaccacctgctcttctctgactaccgggaacccctggtggaggaggctgcccaggtgctcattgtcactttggaccacgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactccaccaagaagatccagttccaccaggagctgctagttctcttctggaagctctgcgacttcaacaagaaattcctcttcttcgtgctgaagagcagcgacgtcctagacatccttgtccccatcctcttcttcctcaacgatgcccgggccgatcagtctcgggtgggcctgatgcacattggtgtcttcatcttgctgcttctgagcggggagcggaacttcggggtgcggctgaacaaaccctactcaatccgcgtgcccatggacatcccagtcttcacagggacccacgccgacctgctcattgtggtgttccacaagatcatcaccagcgggcaccagcggttgcagcccctcttcgactgcctgctcaccatcgtggtcaacgtgtccccctacctcaagagcctgtccatggtgaccgccaacaagttgctgcacctgctggaggccttctccaccacctggttcctcttctctgccgcccagaaccaccacctggtcttcttcctcctggaggtcttcaacaacatcatccagtaccagtttgatggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcatcgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtgaggatgaagccgacgaggggctcagtctaggggaaggcagggccttggtccctgaggcttcccccatccaccattctgagctttaaattaccacgatcagggcctggaacaggcagagtggccctgagtgtcatgccctagagacccctgtggccaggacaatgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccgtggaaatagcctggctccctcttacccagtaatgaggggcagggaagggaactgggaggcagccgtttagtcctccctgccctgcccactgcctggatggggcgatgccacccctcatccttcacccagctctggcctctgggtcccaccacccagccccccgtgtcagaacaatctttgctctgtacaatcggcctctttacaataaaacctcctgctccacaaaaaaaaac

SEQ ID NO: 419266 - DNA, 1814 bp, Homo sapiens
cgagtttaaacggggcgagtttaagcgggcaccagcggttgcagcccctcttcgactgcctgctcaccatcgtggtcaacgtgtccccctacctcaagagcctgtccatggtgaccgccaacaagttgctgcacctgctggaggccttctccaccacctggttcctcttctctgccgcccagaaccaccacctggtcttcttcctcctggaggtcttcaacaacatcatccagtaccagtttgatggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcatcgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtgaggatgaagccgacgaggggctcagtctaggggaaggcagggccttggtccctgaggcttcccccatccaccattctgagctttaaattaccacgatcagggcctggaacaggcagagtggccctgagtgtcatgccctagagacccctgtggccaggacaatgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccgtggaaatagcctggctccctcttacccagtaatgaggggcagggaagggaactgggaggcagccgtttagtcctccctgccctgcccactgcctggatggggcgatgccacccctcatccttcacccagctctggcctctgggtcccaccacccagccccccgtgtcagaacaatctttgctctgtacaatcggcctctttacaataaaacctcctgctccacaaaaaaaaac

SEQ ID NO: 419267 - DNA, 1480 bp, Homo sapiens
ctaaaattggaacgatacagagaagattagcatggcccctgcgcaaggatgacacgcaaattcgtgaagcgttccatatttttcccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcatcgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtgaggatgaagccgacgaggggctcagtctaggggaaggcagggccttggtccctgaggcttcccccatccaccattctgagctttaaattaccacgatcagggcctggaacaggcagagtggccctgagtgtcatgccctagagacccctgtggccaggacaatgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccgtggaaatagcctggctccctcttacccagtaatgaggggcagggaagggaactgggaggcagccgtttagtcctccctgccctgcccactgcctggatggggcgatgccacccctcatccttcacccagctctggcctctgggtcccaccacccagccccccgtgtcagaacaatctttgctctgtacaatcggcctctttacaataaaacctcctgctccacaaaaaaaaac

SEQ ID NO: 419268 - DNA, 3256 bp, Homo sapiens
ggcggggccgacgagggccgggggcggggcgcgccgcttgtctcctgcgagagccgcgggggccgcggagctggagccggagctgaagccggagccgggttggagtctgggcgggggccgggccggagcgggctccagagacatggggtcgaccgactccaagctgaacttccggaaggcggtgatccagctcaccaccaagacgcagcccgtggaagccaccgatgatgccttttgggaccagttctgggcagacacagccacctcggtgcaggatgtgtttgcactggtgccggcagcagagatccgggccgtgcgggaagagtcaccctccaacttggccaccctgtgctacaaggccgttgagaagctggtgcagggagctgagagtggctgccactcggagaaggagaagcagatcgtcctgaactgcagccggctgctcacccgcgtgctgccctacatctttgaggaccccgactggaggggcttcttctggtccacagtgcccggggcagggcgaggagggcagggagaagaggatgatgagcatgccaggcccctggccgagtccctgctcctggccattgctgacctgctcttctgcccggacttcacggttcagagccaccggaggagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggttcagttcttttgttccacggagaacagacatgccctgcccctcttcacctccctcctcaacaccgtgtgtgcctatgaccctgtgggctacgggatcccctacaaccacctgctcttctctgactaccgggaacccctggtggaggaggctgcccaggtgctcattgtcactttggaccacgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactccaccaagaagatccagttccaccaggagctgctagttctcttctggaagctctgcgacttcaacaagaaattcctcttcttcgtgctgaagagcagcgacgtcctagacatccttgtccccatcctcttcttcctcaacgatgcccgggccgatcagtctcgggtgggcctgatgcacattggtgtcttcatcttgctgcttctgagcggggagcggaacttcggggtgcggctgaacaaaccctactcaatccgcgtgcccatggacatcccagtcttcacagggacccacgccgacctgctcattgtggtgttccacaagatcatcaccagcgggcaccagcggttgcagcccctcttcgactgcctgctcaccatcgtggtcaacgtgtccccctacctcaagagcctgtccatggtgaccgccaacaagttgctgcacctgctggaggccttctccaccacctggttcctcttctctgccgcccagaaccaccacctggtcttcttcctcctggaggtcttcaacaacatcatccagtaccagtttgatggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcatcgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtgaggatgaagccgacgaggggctcagtctaggggaaggcagggccttggtccctgaggcttcccccatccaccattctgagctttaaattaccacgatcagggcctggaacaggcagagtggccctgagtgtcatgccctagagacccctgtggccaggacaatgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccgtggaaatagcctggctccctcttacccagtaatgaggggcagggaagggaactgggaggcagccgtttagtcctcctctgtgccctcctctgtgctgtcagcacagaggaggagccagtgttgatcagggtgagggtatcaat

SEQ ID NO: 419269 - DNA, 837 bp, Homo sapiens
gactcttgaggatcccaagtctggaaaaggggaaggcagggccttggtccctgaggcttcccccatccaccattctgagctttaaattaccacgatcagggcctggaacaggcagagtggccctgagtgtcatgccctagagacccctgtggccaggacaatgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccgtggaaatagcctggctccctcttacccagtaatgaggggcagggaagggaactgggaggcagccgtttagtcctccctgccctgcccactgcctggatggggcgatgccacccctcatccttcacccagctctggcctctgggtcccaccacccagccccccgtgtcagaacaatctttgctctgtacaatcggcctctttacaataaaacctcctgctccacaaaaaaaaac

SEQ ID NO: 419270 - DNA, 515 bp, Homo sapiens
ctgggcggggccagcctaggcttaggtaggcgtgtgatgggaaacatgggtcttgggtggccagggtgagccccgtgctcccctggaccacgtgagtgtgctggagatacccctctccccgcaggggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggtgggccccggggagtggggtggtgtccacctgagagcctgcccagcagggctcaacagggacctcagctctgggccccaccacctatggtggacttcatgtcaagacagtcaactaaggcggccttgcctggttgacggtggcacccgctgcccagggtgggacatcgggatggaaagggttggcttggccattcctgctgcccagctcctcctggtgccttgtctgcaag

SEQ ID NO: 419271 - DNA, 1913 bp, Homo sapiens
agaatatttaacagctggcctgacgtggatgctgccatgctggggcctgtactttttgccaggtgttagctgtttagtgctgggttgtggcgggaactcaaaggcactggggcgggggtgttgtgaggtgctcaggcctgacattctgggatagccatagtgggcacacacagccagtgccagccctgccccagcaccctctcttgggctccctgtaccatctccaaccccttgggcagacaccctcctgtcctccaaactcccccttccaggaagcccacccagattggacggggggagctggagggggcctccctgaggcgaaggcatgctccctgcccacaggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcatcgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtgaggatgaagccgacgaggggctcagtctaggggaaggcagggccttggtccctgaggcttcccccatccaccattctgagctttaaattaccacgatcagggcctggaacaggcagagtggccctgagtgtcatgccctagagacccctgtggccaggacaatgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccgtggaaatagcctggctccctcttacccagtaatgaggggcagggaagggaactgggaggcagccgtttagtcctccctgccctgcccactgcctggatggggcgatgccacccctcatccttcacccagctctggcctctgggtcccaccacccagccccccgtgtcagaacaatctttgctctgtacaatcggcctctttacaataaaacctcctgctccacaaaaaaaaac

SEQ ID NO: 419272 - DNA, 3273 bp, Homo sapiens
ggcggggccgacgagggccgggggcggggcgcgccgcttgtctcctgcgagagccgcgggggccgcggagctggagccggagctgaagccggagccgggttggagtctgggcgggggccgggccggagcgggctccagagacatggggtcgaccgactccaagctgaacttccggaaggcggtgatccagctcaccaccaagacgcagcccgtggaagccaccgatgatgccttttgggaccagttctgggcagacacagccacctcggtgcaggatgtgtttgcactggtgccggcagcagagatccgggccgtgcgggaagagtcaccctccaacttggccaccctgtgctacaaggccgttgagaagctggtgcagggagctgagagtggctgccactcggagaaggagaagcagatcgtcctgaactgcagccggctgctcacccgcgtgctgccctacatctttgaggaccccgactggaggggcttcttctggtccacagtgcccggggcagggcgaggagggcagggagaagaggatgatgagcatgccaggcccctggccgagtccctgctcctggccattgctgacctgctcttctgcccggacttcacggttcagagccaccggaggagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggttcagttcttttgttccacggagaacagacatgccctgcccctcttcacctccctcctcaacaccgtgtgtgcctatgaccctgtgggctacgggatcccctacaaccacctgctcttctctgactaccgggaacccctggtggaggaggctgcccaggtgctcattgtcactttggaccacgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactccaccaagaagatccagttccaccaggagctgctagttctcttctggaagctctgcgacttcaacaagaaattcctcttcttcgtgctgaagagcagcgacgtcctagacatccttgtccccatcctcttcttcctcaacgatgcccgggccgatcagtctcgggtgggcctgatgcacattggtgtcttcatcttgctgcttctgagcggggagcggaacttcggggtgcggctgaacaaaccctactcaatccgcgtgcccatggacatcccagtcttcacagggacccacgccgacctgctcattgtggtgttccacaagatcatcaccagcgggcaccagcggttgcagcccctcttcgactgcctgctcaccatcgtggtcaacgtgtccccctacctcaagagcctgtccatggtgaccgccaacaagttgctgcacctgctggaggccttctccaccacctggttcctcttctctgccgcccagaaccaccacctggtcttcttcctcctggaggtcttcaacaacatcatccagtaccagtttgatggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcatcgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtgaggatgaagccgacgaggggctcagtctaggggaaggcagggccttggtccctgaggcttcccccatccaccattctgagctttaaattaccacgatcagggcctggaacaggcagagtggccctgagtgtcatgccctagagacccctgtggccaggacaatgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccgtggaaatagcctggctccctcttacccagtaatgaggggcagggaagggaactgggaggcagccgtttagtcctccctgccctgcccactgcctggatggggcgatgcgggtccctcaagtgcttatccaatgggggttcctccagagtccagtatcacc

SEQ ID NO: 419273 - DNA, 1391 bp, Homo sapiens
ggcggggccgacgagggccgggggcggggcgcgccgcttgtctcctgcgagagccgcgggggccgcggagctggagccggagctgaagccggagccgggttggagtctgggcgggggccgggccggagcgggctccagagacatggggtcgaccgactccaagctgaacttccggaaggcggtgatccagctcaccaccaagacgcagcccgtggaagccaccgatgatgccttttgggaccagttctgggcagacacagccacctcggtgcaggatgtgtttgcactggtgccggcagcagagatccgggccgtgcgggaagagtcaccctccaacttggccaccctgtgctacaaggccgttgagaagctggtgcagggagctgagagtggctgccactcggagaaggagaagcagatcgtcctgaactgcagccggctgctcacccgcgtgctgccctacatctttgaggaccccgactggaggggcttcttctggtccacagtgcccggggcagggcgaggagggcagggagaagaggatgatgagcatgccaggcccctggccgagtccctgctcctggccattgctgacctgctcttctgcccggacttcacggttcagagccaccggaggagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggttcagttcttttgttccacggagaacagacatgccctgcccctcttcacctccctcctcaacaccgtgtgtgcctatgaccctgtgggctacgggatcccctacaaccacctgctcttctctgactaccgggaacccctggtggaggaggctgcccaggtgctcattgtcactttggaccacgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactccaccaagaagatccagttccaccaggagctgctagttctcttctggaagctctgcgacttcaacaaggtgggccagcctcgaggggccctgcagggagatggagagcagctgccccaataacccgggggcagggacagtgtcagactggaggggggtggggaagaag

SEQ ID NO: 419274 - DNA, 905 bp, Homo sapiens
ttgtgctgcgcttggagacctgcccgccctcggggcctgtgtgcacagggaggataggctgtttatctctgcaggctcaggaaggcaggtagctggcccgtcagtcatccgccctgcaaagcgctcccgagagaccccgtagagcgggccagcgcgcgcctggcctgaggtttcccgcccccggaggccctcacatctccccgttctgtagtcagaagtccaacatggttctcaatggcctaaaatcaaggtgtccacaggattgtgttcctttctagagagcaagctgcagtgtggtaaactgcctttgaaagagacccacatgtcaagaaactgagcatcacctgtgaccaacaccttgtgagaaattctgaactagaggacctcgtatgccttacccataggtcttacaagataatacgtgtttttcaaaaaagtaagtttggggataatttcttatgcagcaatagataatgaataataaagtaaatacagttttttgctgttgacttcaaaaatgtttaaagattttactgttatataattgtacatatttatggggtacatgtgatattttgatacatgcatacaatgtgtaatgatcaaactggggtaatttgaatatccatcacctcaaatgttatttagtggtattgggaacattccaaatcttgtaggtattttgaaatatacaaaaagttaattttatatataaatatatgtcatatattattaatatattaataatatatgccatatatatatatgtatgtataaatgccatatatattaattacatgtatggcatgttttcttttatacatttatccactgataaacacttaggttccttccttcccttggctattgtgaatagtgctgcaataaacatgggagtgtagata

SEQ ID NO: 419275 - DNA, 938 bp, Homo sapiens
agctccctcaagactggacagcctatagctatgacagtgggaatttttgctccaagttcttctgtgaaatccttgcctcatacttgccagaagctacatacaaaaaagaataaagtttaaaagggagttccctttcctcactctacaaatcaaatccattgccaaggactgttgcaagctgcagtgtggtaaactgcctttgaaagagacccacatgtcaagaaactgagcatcacctgtgaccaacagccagaaagtaactgaagccccaagacgaacagcttgtgcaaaactaaattctgcctacaacaagagcatgaattgagacgcagatccttccctagttgatccttgaaatgcttgcagctctatggacaccttgattgcagccttgtgagaaattctgaactagaggacctcgtatgccttacccataggtcttacaagataatacgtgtttttcaaaaaagtaagtttggggataatttcttatgcagcaatagataatgaataataaagtaaatacagttttttgctgttgacttcaaaaatgtttaaagattttactgttatataattgtacatatttatggggtacatgtgatattttgatacatgcatacaatgtgtaatgatcaaactggggtaatttgaatatccatcacctcaaatgttatttagtggtattgggaacattccaaatcttgtaggtattttgaaatatacaaaaagttaattttatatataaatatatgtcatatattattaatatattaataatatatgccatatatatatatgtatgtataaatgccatatatattaattacatgtatggcatgttttcttttatacatttatccactgataaacacttaggttccttccttcccttggctattgtgaatagtgctgcaataaacatgggagtgtagata

SEQ ID NO: 419276 - DNA, 982 bp, Homo sapiens
gcctgagcgcccccaattgggtggattttgattgcacatatggagaatagcacttaacagtttacaaagcacttcatcctcctaacattcagtaaaatacattttatcgaaactctccattaactataacttcctcttgcccaagtctaaaatgttcagggaaggtccatgcccttttttctcttgcatttttccttcataggaagtatgagaagatgctttttctccactcagcttgaatcatgcttttggttttgtctctgacagatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419277 - DNA, 4652 bp, Homo sapiens
gttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacatactagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaatgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtttggcagggctcttttaagagtcttcttgtgagagtgggcccctcagggtatacattgtgcctttagagaatggggaattataggtcccctaccttaagtctccccctcttttatccttgccaggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419278 - DNA, 547 bp, Homo sapiens
  misc_feature (1)..(1): n is a, c, g, or t
ntatactttgtccacttcaagtactgcatgtgtaaagggtatagggtaaaagatggtgatattaattgaagtggaacctagaagaattgttgaaaaggttataggagctagattcattcattattcattctttgtaaaacataatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419279 - DNA, 573 bp, Homo sapiens
aaaaagtaggaaaagtgttagaggacaaaatgggagtaggggagaccctcagttagtggtgacagttactaatggatttaattaacttcaatatcccttctgtgcactgaggaagatgtctgacaattttccttaagggcagtcaggctttttagttttctggagtcaggtaggagtggggagacatgttcctacctccctttgctgggtcccaaactattccacctttacttaccccagaacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagagtaagacctgggatgggacaagggaaactggactgggtggattttgtattttgtttgtttgtgacagggtctcactctgtcacccaggctgaagtgcagtagcgtgattacagctcactgcagcctcgacttcc

SEQ ID NO: 419280 - DNA, 4653 bp, Homo sapiens
gttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacatactagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaatgagtggtatacccttcagctcagttgggaaggctccccaaaatgtcctgtaatatcagggagagggtgttggggactaactgtgggtagaggggagaaccaggagtatagcatctaattttccctcagataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419281 - DNA, 4664 bp, Homo sapiens
agagaattctgggtaactagccgtttccgtcaccttcccctgcccccgccccaattgtgggtaactggccattattgttttcctctagagaatcctgggtagctattggagaggattctaggaaactgacttctcgttctccccaccgtccaatccacccgttttcacccccaattctgggagaaagcaccttaaatccctctacctaactccaacccccgcaattctcgctcccttcacctgatgattcagggctgaacaaggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacatactagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaatgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419282 - DNA, 2880 bp, Homo sapiens
ggacgcgctgggtcgacccacgcgtccggaggaaccagcatctccacatggtttctaataaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaatgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419283 - DNA, 4472 bp, Homo sapiens
gttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacatactagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaatgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcgggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419284 - DNA, 4479 bp, Homo sapiens
gttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacatactagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaatgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419285 - DNA, 4472 bp, Homo sapiens
gttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacatactagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaatgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419286 - DNA, 1501 bp, Homo sapiens
ccgatgaagatgccgttttcgccgctcgagcgctccgcaaccaagaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtttggcagggctcttttaagagtcttcttgtgagagtgggcccctcagggtatacattgtgcctttagagaatggggaattataggtcccctaccttaagtctccccctcttttatccttgccaggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419287 - DNA, 1154 bp, Homo sapiens
aaaaagtaggaaaagtgttagaggacaaaatgggagtaggggagaccctcagttagtggtgacagttactaatggatttaattaacttcaatatcccttctgtgcactgaggaagatgtctgacaattttccttaagggcagtcaggctttttagttttctggagtcaggtaggagtggggagacatgttcctacctccctttgctgggtcccaaactattccacctttacttaccccagaacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419288 - DNA, 4597 bp, Homo sapiens
gttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacatactagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaatgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagagaactgctagtgtgggttctctggcttcagtcttcctctccttcctttgaaggtaaaggtccggaatccaaag

SEQ ID NO: 419289 - DNA, 3691 bp, Homo sapiens
gttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacatactagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaatgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggcccaatgtaccaagccttgacactgactacccgttccatatgccccgaagacgactgattaccgtgcgattgcttgcttcgtactttctggacctgtagattcaacgtggaacccatgacaggattggcgatgctcgcacagaccttaacttgacccaatgtattgggctc

SEQ ID NO: 419290 - DNA, 2768 bp, Homo sapiens
gttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacatactagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaatgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagcgttttgggatcctctagatcacccg

SEQ ID NO: 419291 - DNA, 353 bp, Homo sapiens
cgcatcttcgtcccatcaggttcagtggaggtggattgtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419292 - DNA, 4526 bp, Homo sapiens
gttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacatactagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaatgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419293 - DNA, 4560 bp, Homo sapiens
agagaattctgggtaactagccgtttccgtcaccttcccctgcccccgccccaattgtgggtaactggccattattgttttcctctagagaatcctgggtagctattggagaggattctaggaaactgacttctcgttctccccaccgtccaatccacccgttttcacccccaattctgggagaaagcaccttaaatccctctacctaactccaacccccgcaattctcgctcccttcacctgatgattcagggctgaacaaggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaagggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacatactagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaatgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419294 - DNA, 4912 bp, Homo sapiens
gttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacatactagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaatgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggaggtgagtgaggttgtagagggcaggaacactcctgggatggccacagtgagtcccagatctgtccttgagtctgagacagagtggtccagccatcaatttgtatcgccacaggctttctttgtatttccatagggcgttactcaccagcagtggtatctgttcaatgactttcttattgaacctattgataaggttagttgcaacatgttctgtttcttctttcatttccccttttcctagcatccttatctttagggctctatagaatgccaggcagattcaacagggagggaggaaggaatcctcaggaataaaaaccattagcacttaaaaatagcacctgaaaaaaaacaaaaactagcacctgagtcctggcctccgtctgaagtgggggaaaaggaaaagggtgatatacattagccataagtgctttttctcttctatagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419295 - DNA, 4432 bp, Homo sapiens
gttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacatactagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaatgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatgacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419296 - DNA, 4454 bp, Homo sapiens
gttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacatactagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaatgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtttggcagggctcttttaagagtcttcttgtgagagtgggcccctcagggtatacattgtgcctttagagaatggggaattataggtcccctaccttaagtctccccctcttttatccttgccaggtgcccaaggaccaagtccttgacactgtctacctgttccatatgccccgaaaacgaatgatttccctgcgattccttgcttggtactttctggatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419297 - DNA, 736 bp, Homo sapiens
tcggggcaattctggactcggggcaattctggactctgatgttcgccgaccgttgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419298 - DNA, 3945 bp, Homo sapiens
gttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacatactagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaatgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagagtaagacctgggatgggacaagggaaactggactgggtggattttgtattttgtttgtttgtgacagggtctcactctgtcacccaggctgaagtgcagtagcgtgattacagctcactgcagcctcgacttcc

SEQ ID NO: 419299 - DNA, 2795 bp, Homo sapiens
gttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacatactagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccaggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgagcagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagaga

SEQ ID NO: 419300 - DNA, 405 bp, Homo sapiens
cctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacggggtaagaactgtacccctttgtgagggttgaaagatgttgaaggtctttatctggtcttaacccaaggaagctgctttgcagatagccagtaccgaggagttgtagtgatgagacagctgggtctggttggagggataaagggagaatctaggatctaggagtaaatgacatattctttctca

SEQ ID NO: 419301 - DNA, 1919 bp, Homo sapiens
aatcagctatttcatgcagtgcaaagattgcaaagagtacaaaaccagctgaaaagcatgcgccaagctgcagcagatgcaaagcctgaaagtttaatgaagaggctagaggaggagataaaatttaatttatatatggtaactgaaaaatttcctaaagaattagaaaataagaaaaaggaattacattttttacaaaaagtagtttcagagccagctatgggccattctgatcttcttgaacttgaatctaaaataaatgaaataaacacagaaattaaccagttgattgaaaagaaaatgatgagaaatgagcccattgaaggcaaactctcactgtataggcaacaggcatctatcatttcccgtaaaaaagaagccaaagctgaggaacttcaggaggccaaggagaagttagccagcctagagagagaagcatcagtaaagagaaatcagacccgtgaatttgatggtactgaagttttaaagggagatgagttcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagaaacttcgggaaaaacaaaaagttatacgagaaagtcatggtccaaatatgaaacaagcaaaaatgtggcgtgatttggaacaattaatggaatgtaagaaacagtgctttctgaaacaacaaagccaaacttccattggtcaggtaattcaggagggtggggaggaccggctaatactgtgaattcttgtgtcatcgtttggggttttacttgataccactagctataagcctaatctcataatgtatttcttttttgaaactgatttgtatagcattttgttttcagaagagccattctttattaagttttcatagaaaataatgttaaggtagatttagtttgaatgttttttcatatgaaaaagaggcttttattcttttccatagtttagacatcactggcgtcttctgagttttatgagacaggaaactaagtttactatctgtaaatgtaaacatatgtccattaagaaacatgtagtttttttttagaatgtaataacccagtggcttactgtttttcttaatctcttttaaaaaaactttagaagaatcttttaggaactaatatctcttgttctgaagaaacatttatctgacgttcagcagttcctacagttttacttcagtttatttttcttctgtaaaatgcaagaaaatttaatattttgactaacatgtcttttctgtttgtatcatttaaaggcaaataaacttggtacgtatttcatatctatttaaaaaatgtaaaaaaaaat

SEQ ID NO: 419302 - DNA, 2501 bp, Homo sapiens
cttcctgaaaggatctggagacaccagctccacaagtcctggtgtctttaaaaggatcagcttgaggaataaggctcgtctgagagctgtgacattcatctgactctagtgaaagtccaacagccactccctttttggcctccaactgggcaccatgagggcctgcatctccctggtattggccgtgctgtgtggcctggcctgggctgaggaccacaaagagtcagagccattgccacagctggaggaagagacagaagaggccctcgccagcaacttgtactcggcacccacctcctgccagggccgctgctacgaagcctttgacaagcaccaccaatgtcactgcaatgcccgctgccaagagtttgggaactgctgcaaggattttgagagcctgtgtagtgaccacgaggtctcccacagcagtgatgccataacaaaagaggagattcagagcatctctgagaagatctacagggcagacaccaacaaagcccagaaggaagacatcgttctcaatagccaaaactgcatctccccgtcagagaccagaaaccaagtggatcgctgcccaaagccactcttcacttatgtcaatgagaagctgttctccaagcccacctatgcagccttcatcaacctcctcaacaactaccagcgggcaacaggccatggggagcacttcagtgcccaggagctggccgagcaggacgccttcctcagagagatcatgaagacagcagtcatgaaggagctctacagcttcctccatcaccagaatcgctatggctcagagcaagagtttgtcgatgacttgaagaacatgtggtttgggctctattcgagaggcaatgaagagggggactcgagtggctttgaacatgtcttctcaggtgaggtaaaaaaaggcaaggttactggcttccataactggatccgcttctacctggaggagaaggagggtctggttgactattacagtcacatctacgatgggccttgggattcttaccccgatgtgctggcaatgcagttcaactgggacggctactataaggaagtgggctctgctttcatcggcagcagccctgagtttgagtttgcactctactccctgtgcttcatcgccaggccaggcaaagtgtgccagttaagcctgggaggatatcccttagctgtccggacatatacctgggacaagtccacctatgggaatggcaagaagtacatcgccacagcctacatagtgtcttccacctaatagaacttcgagccagaaaggggcatgagggctcttgcgagactgaagtgctatcttctctggactagagagaagagggagaggactggaagggatcaccaaatctcaaagcaatgagaagcattcctaaatcccaaagtgcccacatgggaaagagataaaatgtacaaattagaaaaatgtggataaacagtcaaacctttatcctctagaattttggcaatgttgactaagaaacagagtccaagcagagaaggtaggaaccctccatagctctctgccctgatgtgtgggggaactaggaagaagtcctttgacctcaccaggcctcatgcttccctttaatgtaaagggaaggggtttgcccactttcctctttttggggttggtgagagggcaaaccctgatatttttactgtgaaggtgttttcagttgttcttaggaagaacagctgatagaaattcaagattactataatggctgttattatacacagctctgtaaactaccactcagccctgtgttggggtcctcaaagaagtaaggccacagtaatcaagcaagggcctttggttttttccagagttagatcctctcagaacagagtctgggagaactccaatgctgaatggagaagggtaataggttggtgcagtgaatgggctgggggtggggtggccttctccaggcctgagtgtttttgtgtccagctcagtatctgcaacaagaagtttcccacttgtggatgtttagtgcagccacagacttgtattttgatccccaattttttttttgaaagagttctcctcataggaggatgattcagcatcagaagaagaaggaacccatagcttggtgtcattaacataattattttaagccttatccagcagccataatttgaataactctacgagaccagagagactgtagttccctattttaacctcaattatgcatttgtcccccaaccccactgagaactaaatgctgtaccacagagccgggtgtgaactatggtttagaaggttcaagtttccaattaaagtcattgaagaaaacttgaaatgagtgtcttctttgtatatggcctccctccaatgtctgtctccctgccttttccctagagcagggctggcagtgatacttttgctctagagtcttttcagaatggcttgaagaatgtggtatctgggtgaagtctctgttgactcactaagtctctctagccaagag

SEQ ID NO: 419303 - DNA, 1661 bp, Homo sapiens
ctcgcgaacgtatatccgaacgagggggaccgagtggcttgaacatgtcttctcaggtgaggtaaaaaaaggcaaggttactggcttccataactggatccgcttctacctggaggagaaggagggtctggttgactattacagtcacatctacgatgggccttgggattcttaccccgatgtgctggcaatgcagttcaactgggacggctactataaggaagtgggctctgctttcatcggcagcagccctgagtttgagtttgcactctactccctgtgcttcatcgccaggccaggcaaagtgtgccagttaagcctgggaggatatcccttagctgtccggacatatacctgggacaagtccacctatgggaatggcaagaagtacatcgccacagcctacatagtgtcttccacctaatagaacttcgagccagaaaggggcatgagggctcttgcgagactgaagtgctatcttctctggactagagagaagagggagaggactggaagggatcaccaaatctcaaagcaatgagaagcattcctaaatcccaaagtgcccacatgggaaagagataaaatgtacaaattagaaaaatgtggataaacagtcaaacctttatcctctagaattttggcaatgttgactaagaaacagagtccaagcagagaaggtaggaaccctccatagctctctgccctgatgtgtgggggaactaggaagaagtcctttgacctcaccaggcctcatgcttccctttaatgtaaagggaaggggtttgcccactttcctctttttggggttggtgagagggcaaaccctgatatttttactgtgaaggtgttttcagttgttcttaggaagaacagctgatagaaattcaagattactataatggctgttattatacacagctctgtaaactaccactcagccctgtgttggggtcctcaaagaagtaaggccacagtaatcaagcaagggcctttggttttttccagagttagatcctctcagaacagagtctgggagaactccaatgctgaatggagaagggtaataggttggtgcagtgaatgggctgggggtggggtggccttctccaggcctgagtgtttttgtgtccagctcagtatctgcaacaagaagtttcccacttgtggatgtttagtgcagccacagacttgtattttgatccccaattttttttttgaaagagttctcctcataggaggatgattcagcatcagaagaagaaggaacccatagcttggtgtcattaacataattattttaagccttatccagcagccataatttgaataactctacgagaccagagagactgtagttccctattttaacctcaattatgcatttgtcccccaaccccactgagaactaaatgctgtaccacagagccgggtgtgaactatggtttagaaggttcaagtttccaattaaagtcattgaagaaaacttgaaatgagtgtcttctttgtatatggcctccctccaatgtctgtctccctgccttttccctagagcagggctggcagtgatacttttgctctagagtcttttcagaatggcttgaagaatgtggtatctgggtgaagtctctgttgactcactaagtctctctagccaagag

SEQ ID NO: 419304 - DNA, 2433 bp, Homo sapiens
tccattcggacgtctccatcctcagaacctcctctcttccccaaaaagcaccatgacttgtggatcttactgtggtggccgcgccttcagctgcatctcggcctgtgggccccggcccggccgctgctgcatcaccgctgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcagattcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaaatcagacctggaggccaatgtggaggccctgatccaggagatcgacttcctgaggcggctgtatgaggaggagatccgcgttctccagtcccacatctcagacacctccgtggttgtcaagctggacaacagccgggacctgaacatggactgcatcattgccgagatcaaggcacagtacgatgacattgtcacccgtagccgggctgaggccgagtcctggtaccgcagcaagtgtgaggagatgaaggccacggtgatcaggcacggggagaccctgcgccgcaccaaggaggagatcaacgagctgaaccgcatgatccagaggctgacggctgaggtggagaatgccaagtgccagaattccaagctggaggctgcggtggctcagtctgagcagcagggtgaggcggccctcagcgatgcccgctgcaagttggccgagctggagggtgccctgcagaaggccaagcaggacatggcctgcctgatcagggagtaccaggaggtgatgaactccaagctgggcctggacatcgagatcgccacctacaggcgcctgctggagggcgaggagcagaggctgtgcgagggcgtcggctcggtgaatgtctgcgtcagcagctcccgcggtggcgttgtctgtggcgatctctgcgcctccactactgcccctgttgtctccaccagagtcagtagcgtccccagcaacagcaacgtggtggtgggcactactaacgcctgcgccccctccgcccgggttggcgtctgcggcggcagctgtaagaggtgctaggaggctgccgcctccgccagcgcctgtcgccgtcactctccacccagccagtacctcgcgccaccagaacgcgccgcccgcgccggcctcccaatagccgccgcccgctgcctgcactctaagcgccctccccaccgctccgctccgggagccatccccggtcgcaggagtccggggagggccgggaggcgccatggtctctctctgtagcctttcctggtagtcaatttgttgtcccgaggattcatctttttcttccgcctgccttctgttttttttgctgtatgcattggtcttgcctgagctcttccccaaagcttggaggaacgggggaggcccgggaatgtccctgtctgcacgacctgggactctgcccatgtgcttttgcctgtggaatggagacgcggaccctggatagtggttctatgactctgcgagggacaggcccacgcgtgtggggagaacatctcccttccggggctgccctcaagagcttctgaaaaactaatgactctgctgccttctcctttgtctttgtttcactctgtgtttccaataaactcattgtagcgaatcaaaaaaaaaatcgccctcgtgtctcagcgtgagctctgcgcgctcctttatgaggctactatgacctcctcctgaccctggctcgccgttgctgggaacggaccctactaagccgcatcgattcagaccggacacagaaaactgccaagcacaagccgacctaaggcggttgcctttattctcgccctaacacccaatcccataaggcgaacgagcacaaaagggtccgaatcttgctcttcacctcgtacacgccttcctgcacgggttacatcgcgaagtggcgcgccgcggccgcgtcgcgcgtcgcttgtccgaacttctcgcggcgaacgtctcccgcg

SEQ ID NO: 419305 - DNA, 2091 bp, Homo sapiens
tccattcggacgtctccatcctcagaacctcctctcttccccaaaaagcaccatgacttgtggatcttactgtggtggccgcgccttcagctgcatctcggcctgtgggccccggcccggccgctgctgcatcaccgctgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcagattcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaaatcagacctggaggccaatgtggaggccctgatccaggagatcgacttcctgaggcggctgtatgaggaggagatccgcgttctccagtcccacatctcagacacctccgtggttgtcaagctggacaacagccgggacctgaacatggactgcatcattgccgagatcaaggcacagtacgatgacattgtcacccgtagccgggctgaggccgagtcctggtaccgcagcaagtgtgaggagatgaaggccacggtgatcaggcacggggagaccctgcgccgcaccaaggaggagatcaacgagctgaaccgcatgatccagaggctgacggctgaggtggagaatgccaagtgccagaattccaagctggaggctgcggtggctcagtctgagcagcagggtgaggcggccctcagcgatgcccgctgcaagttggccgagctggagggtgccctgcagaaggccaagcaggacatggcctgcctgatcagggagtaccaggaggtgatgaactccaagctgggcctggacatcgagatcgccacctacaggcgcctgctggagggcgaggagcagaggctgtgcgagggcgtcggctcggtgaatgtctgcgtcagcagctcccgcggtggcgttgtctgtggcgatctctgcgcctccactactgcccctgttgtctccaccagagtcagtagcgtccccagcaacagcaacgtggtggtgggcactactaacgcctgcgccccctccgcccgggttggcgtctgcggcggcagctgtaagaggtgctaggaggctgccgcctccgccagcgcctgtcgccgtcactctccacccagccagtacctcgcgccaccagaacgcgccgcccgcgccggcctcccaatagccgccgcccgctgcctgcactctaagcgccctccccaccgctccgctccgggagccatccccggtcgcaggagtccggggagggccgggaggcgccatggtctctctctgtagcctttcctggtagtcaatttgttgtcccgaggattcatctttttcttccgcctgccttctgttttttttgctgtatgcattggtcttgcctgagctcttccccaaagcttggaggaacgggggaggcccgggaatgtccctgtctgcacgacctgggactctgcccatgtgcttttgcctgtggaatggagacgcggaccctggatagtggttctatgactctgcgagggacaggcccacgcgtgtggggagaacatctcccttccggggctgccctcaagagcttctgaaaaactaatgactctgctgccttctcctttgtctttgtttcactctgtgtttccaataaactcattgtagcgaatcaa

SEQ ID NO: 419306 - DNA, 763 bp, Homo sapiens
cctttcatgaaagcaattcaaccaactgcggctccacccaaagagcttctatacttacttttcttacagtttttgagtgacgcactacaaaacgatgaaaaaaaaaagaagaagaagaaaaggaggaggcagccctctcctacagggcgtcttccgccctgtaaacttggcaaaaggcaaactggcctgaaatacagcactctccatataaggcagcccagctaaacatgtcatgcgtaatttatgggtagcaagcagagaattaacctttgcgtgcacatatttggcccagatgaaaaccgggcgggatggcagccccggggccagggatgcgggagccgccgggaagacccgcgcgccgctcgactcagagggactcacaccttcccccgacaaaggtcattaagttaggcggccccactgtcgaccaagtgcccaaggattgtgggagtcatgattccaagatgcccgcgacggaaaatggaacttgtcagctccttgtcatgggagcattgtgggcgccacaactcattcagctgcagtgaaaagactgttgcatgtcgctgtgcagcctcttatcgccgaggtctggcttccgctgctgctgcgcggcccctcccccgcccgcccagccccaccaggaagcccagggcggactcgtcgagctcctaatgcacgcggcggcgagaaaaacgctcttcaactttccgccggcgccctcccgcgcttccccgggccacagggtcgcctgtcaaccggacag

SEQ ID NO: 419307 - DNA, 520 bp, Homo sapiens
cctttcatgaaagcaattcaaccaactgcggctccacccaaagagcttctatacttacttttcttacagtttttgagtgacgcactacaaaacgatgaaaaaaaaaagaagaagaagaaaaggaggaggcagccctctcctacagggcgtcttccgccctgtaaacttggcaaaaggcaaactggcctgaaatacagcactctccatataaggcagcccagctaaacatgtcatgcgtaatttatgggtagcaagcagagaattaacctttgcgtgcacatatttggcccagatgaaaaccgggcgggatggcagccccggggccagggatgcgggagccgccgggaagacccgcgcgccgctcgactcagagggactcacaccttcccccgacaaaggtcattaagttgtgagtacacttgcacgcacctgtttctcttctcgcccccctgtttctccctgggtcccgctgggctgccaagccgtgcgcgggctgtgccgtgacagcgtccgcagagcc

SEQ ID NO: 419308 - DNA, 476 bp, Homo sapiens
aaagagaggccagcgagatctgtgatggagtccagaactaaactgcacaatgaaagcaagaagacggcccccaggcaggaggccatccccgatctggaggactctccgccagtgtcggattcagagttttgttggtccagtttcgccttctgagcagttcttctgtatcccgggaaaagtacgctcggccccaaactggtatttgtcagacgatacatgtaaaagtttgtccttgaacgtggaacaagacttgtgtaaagtctgagacgggaactagtgatcactagctcaagaactgcaaatgagacaggaagctgttcactgtgaaacagtctcttgcttgtcgtgtatttttcgagtacttctgaagtgtgaagtaaaaaaatctggctaatttatttgtacaaatacactttgataattttttatattttcataaacttttacagatgtaaaattaaagaacttcacttgtt

SEQ ID NO: 419309 - DNA, 4300 bp, Homo sapiens
  misc_feature (789)..(789): n is a, c, g, or t
taatcattctaagaagagccggatgttaatcagacgaggtgcagactctctttggaaagaagaaatcattcgacccgtccgccagagagcctcccgggtccaccgcaggtctcccccaggagcccaaaaccacagcagaggacggggtgccggcacctccgttgttagatccgatcgtccagcagttcggtcagttctcaaaagataaggctctagaggaagaggaggacgacaggccatacgaccctgaggaggagtacgacccggagagggccttcgacactcagcttgtggagcgagggcggcgccacgaggtggaaagggctcctgaagcagctgcagccgagcgggaagaggtggcctatgaccccgaggatgagaccatcttagaagaagcgaaagtgactgttgatgacctgcccaacaggatgtgtgccgacgtgagaaggaactccgtggagaggcctgccgagccggtggccggggctgcgacgccctccctggtggagcaacagaagatgctagaagagctgaacaaacagatcgaggagcagaagagacagctggaggagcaagaagaagctctcaggcagcagagggccgccgtcggggtctccatggcccacttctcggtgtcggacgccttgatgtctccaccaccaaagtcgtccttgcccaaggcagagctgttccagcaagagcagcagtctgcagacaagcccgcctcactgccccccgccagccaggcgtcaaaccacagggacccccggcaggcgaggcgcctggccnctgagaccggtgagggggagggggagcctctctccaggctctcggcacgtggtgcccagggtgccctgcccgagagagatgcttccaggggtggcctcgtgggccaggcgcccatgccagtcccggaggaaaaagagccagcctcttccccctgggcttcgggcgaaaagcccccagcggggtccgagcaggacggctggaaggcagagcctggggagggcacccgccccgccacggttggagacagctcggccaggcctgcccggagggtgctgctgcccacaccgccttgcggcgccctgcagcccggcttcccgctgcagcacgacggtgagagggaccctttcacctgcccggggttcgcgtcgcaggacaaggctctcggctcagcccagtatgaggacccaagaaatcttcattctgctggaaggagcagcagccctgcaggtgaaacagagggggacagagagccacaggccagacccggcgagggcaccgccccgctccccccaccaggacagaaagtggggggctctcagcccccgtttcagggtcagcgggaacctggacctcatgctttggggatgtcagggcttcacggccccaatttcccgggaccaagggggccagcccctccgtttccagaagagaatatcgcttctaacgatgggccacgagggcctccgccagccagattcggagcccagaaggggcccatcccttccttattctcggggcaacatgggccacctccttatggggacagcagaggcccctcaccctcttaccttggtggaccacgaggagtggcaccatcccaatttgaagaacgcaaggatccccatggggagaagagggagttccaggacgccccgtataacgaggtgacgggcgcccccgcccagtttgaagggacagagcaagccccatttctgggaagcagaggcggcgcgcctttccagttcggaggccagagaaggccactgctgtctcagctgaaaggcccccgaggcggcccccctccctctcagtttggaggtcagagaggaccaccccctggtcatttcgtgggcccaagagggccccatcctagtcagtttgaaactgcccggggccctcatcccaaccagtttgaaggacccagaggccaagcgcctaactttatgccaggtcccaggggcattcagcctcagcagttcgaagaccagagggtccattcaccaccaagattcacaaaccaaagggcgcctgcacccctgcagtttggtggactacgggggtccgcacccttttctgaaaaaaatgagcagaccccttcgcgatttcacttccagggccaggccccgcaggtgatgaagccgggccccaggcccctgctggagcttcccagccaccccccgcagcaccggaaggaccgctgggaggaggccgggccgccctccgcgctctcctccagtgcgcccggacagggccccgaggccgacggacagtgggcatcggccgacttccgagaggggaaaggccacgaatacagaaaccagactttcgaagggaggcagagagagcggtttgacgtggggcccaaagagaagccgctggaggagcccgacgcccagggccgggcgtccgaggacaggaggagagagcgcgagcgcggccgaaactggagccgagagcgggactgggaccggccccgggagtgggaccgacaccgggacaaggactccagccgggactgggacagaaaccgggagaggagcgccaaccgcgaccgagagcgcgaggccgaccggggcaaggagtgggaccgcagccgggagcggagcaggaaccgagagcgcgagcgagaccggaggcgcgaccgggaccggtcccggagcagagagcgggaccgagacaaggccagggacagggagcggggccgcgaccgcaaggaccggagcaagagcaaagagagcgctcgggacccgaagcccgaggcctcgagggcctccgacgctggcaccgcctcgcaggcctagacgccccggccgggcagagaccctttttaaagccacgttcgtaagatgcgttgaacaaatagcttttgaaatagccacgatcttagattcaggatagaatattctggacttaaacattactgtaattttgtgtaaatggtttcttacaagatttcacatctttacaattctgatgcttttttaaaaaaactaaactttaatatttccatttaaaattaaaagaaatgggaaattgcctacggagcatattgcttttcagatcatagttatcttttccaataactttattgtaaattttaagggagtttcgttggaccctagagccataccttcactgacatctcatccgtttgtgtttccaaaagctgcttttacaggtcttagccgccgccccggaggccggtgtgggcgtgacctgcaggcgtccaccctgcggctacgggagaagtcttagtagcttgtatctggagtcttgagaaacacaaaccttacaaatgcatctttcttttgtcataaaattggaattacaattttcaactgggaaacagaaacacatttcttagcgtgctcagattttatatatcaccttatcaattttttccaaaacatgatttaaagcaacatctgtcctagtataattgttgcattttaaataacaatttattgaaaaatgttaagttttaccagcctaaaaaaagtaacaaaccaattaagtgtactttgggggcagggaggagtccttgatttgaataatcaggagttttgttggtccagtttcgccttctgagcagttcttctgtatcccgggaaaagtacgctcggccccaaactggtatttgtcagacgatacatgtaaaagtttgtccttgaacgtggaacaagacttgtgtaaagtctgagacgggaactagtgatcactagctcaagaactgcaaatgagacaggaagctgttcactgtgaaacagtctcttgcttgtcgtgtatttttcgagtacttctgaagtgtgaagtaaaaaaatctggctaatttatttgtacaaatacactttgataattttttatattttcataaacttttacagatgtaaaattaaagaacttcacttgttctttggagtctgttattccattgtacgtcactacagatttttcactttatagcacagattttttaagttaagaaaacattgagaatgtatcagtttgagatgtttggtgttgaaagccaagtgtccataggttaaattacattaaagtaggtgtcacgttccaacatctagtacgatgagaaggttttgtttgtttaacatataaagcaaatttttctaatttaaatacacaaatgtaaaaatcaagtgtgtttctttagtttacttgatagagattcctgtacattgtattttatattgcggaggcttatatcactgtacatgagaacatggaacgacctaggttttgttactcgcagtagaataaacagctacaggaa

SEQ ID NO: 419310 - DNA, 4273 bp, Homo sapiens
  misc_feature (789)..(789): n is a, c, g, or t
taatcattctaagaagagccggatgttaatcagacgaggtgcagactctctttggaaagaagaaatcattcgacccgtccgccagagagcctcccgggtccaccgcaggtctcccccaggagcccaaaaccacagcagaggacggggtgccggcacctccgttgttagatccgatcgtccagcagttcggtcagttctcaaaagataaggctctagaggaagaggaggacgacaggccatacgaccctgaggaggagtacgacccggagagggccttcgacactcagcttgtggagcgagggcggcgccacgaggtggaaagggctcctgaagcagctgcagccgagcgggaagaggtggcctatgaccccgaggatgagaccatcttagaagaagcgaaagtgactgttgatgacctgcccaacaggatgtgtgccgacgtgagaaggaactccgtggagaggcctgccgagccggtggccggggctgcgacgccctccctggtggagcaacagaagatgctagaagagctgaacaaacagatcgaggagcagaagagacagctggaggagcaagaagaagctctcaggcagcagagggccgccgtcggggtctccatggcccacttctcggtgtcggacgccttgatgtctccaccaccaaagtcgtccttgcccaaggcagagctgttccagcaagagcagcagtctgcagacaagcccgcctcactgccccccgccagccaggcgtcaaaccacagggacccccggcaggcgaggcgcctggccnctgagaccggtgagggggagggggagcctctctccaggctctcggcacgtggtgcccagggtgccctgcccgagagagatgcttccaggggtggcctcgtgggccaggcgcccatgccagtcccggaggaaaaagagccagcctcttccccctgggcttcgggcgaaaagcccccagcggggtccgagcaggacggctggaaggcagagcctggggagggcacccgccccgccacggttggagacagctcggccaggcctgcccggagggtgctgctgcccacaccgccttgcggcgccctgcagcccggcttcccgctgcagcacgacggtgagagggaccctttcacctgcccggggttcgcgtcgcaggacaaggctctcggctcagcccagtatgaggacccaagaaatcttcattctgctggaaggagcagcagccctgcaggtgaaacagagggggacagagagccacaggccagacccggcgagggcaccgccccgctccccccaccaggacagaaagtggggggctctcagcccccgtttcagggtcagcgggaacctggacctcatgctttggggatgtcagggcttcacggccccaatttcccgggaccaagggggccagcccctccgtttccagaagagaatatcgcttctaacgatgggccacgagggcctccgccagccagattcggagcccagaaggggcccatcccttccttattctcggggcaacatgggccacctccttatggggacagcagaggcccctcaccctcttaccttggtggaccacgaggagtggcaccatcccaatttgaagaacgcaaggatccccatggggagaagagggagttccaggacgccccgtataacgaggtgacgggcgcccccgcccagtttgaagggacagagcaagccccatttctgggaagcagaggcggcgcgcctttccagttcggaggccagagaaggccactgctgtctcagctgaaaggcccccgaggcggcccccctccctctcagtttggaggtcagagaggaccaccccctggtcatttcgtgggcccaagagggccccatcctagtcagtttgaaactgcccggggccctcatcccaaccagtttgaaggacccagaggccaagcgcctaactttatgccaggtcccaggggcattcagcctcagcagttcgaagaccagagggtccattcaccaccaagattcacaaaccaaagggcgcctgcacccctgcagtttggtggactacgggggtccgcacccttttctgaaaaaaatgagcagaccccttcgcgatttcacttccagggccaggccccgcaggtgatgaagccgggccccaggcccctgctggagcttcccagccaccccccgcagcaccggaaggaccgctgggaggaggccgggccgccctccgcgctctcctccagtgcgcccggacagggccccgaggccgacggacagtgggcatcggccgacttccgagaggggaaaggccacgaatacagaaaccagactttcgaagggaggcagagagagcggtttgacgtggggcccaaagagaagccgctggaggagcccgacgcccagggccgggcgtccgaggacaggaggagagagcgcgagcgcggccgaaactggagccgagagcgggactgggaccggccccgggagtgggaccgacaccgggacaaggactccagccgggactgggacagaaaccgggagaggagcgccaaccgcgaccgagagcgcgaggccgaccggggcaaggagtgggaccgcagccgggagcggagcaggaaccgagagcgcgagcgagaccggaggcgcgaccgggaccggtcccggagcagagagcgggaccgagacaaggccagggacagggagcggggccgcgaccgcaaggaccggagcaagagcaaagagagcgctcgggacccgaagcccgaggcctcgagggcctccgacgctggcaccgcctcgcaggcctagacgccccggccgggcagagaccctttttaaagccacgttcgtaagatgcgttgaacaaatagcttttgaaatagccacgatcttagattcaggatagaatattctggacttaaacattactgtaattttgtgtaaatggtttcttacaagatttcacatctttacaattctgatgcttttttaaaaaaactaaactttaatatttccatttaaaattaaaagaaatgggaaattgcctacggagcatattgcttttcagatcatagttatcttttccaataactttattgtaaattttaagggagtttcgttggaccctagagccataccttcactgacatctcatccgtttgtgtttccaaaagctgcttttacaggtcttagccgccgccccggaggccggtgtgggcgtgacctgcaggcgtccaccctgcggctacgggagaagtcttagtagcttgtatctggagtcttgagaaacacaaaccttacaaatgcatctttcttttgtcataaaattggaattacaattttcaactgggaaacagaaacacatttcttagcgtgctcagattttatatatcaccttatcaattttttccaaaacatgatttaaagcaacatctgtcctagtataattgttgcattttaaataacaatttattgaaaaatgttaagttttaccagcctaaaaaaagtaacaaaccaattaagtgtactttgggggcagggaggagtccttgatttgaataatcaggagttttgttggtccagtttcgccttctgagcagttcttctgtatcccgggaaaagtacgctcggccccaaactggtatttgtcagacgatacatgtaaaagtttgtccttgaacgtggaacaagacttgtgtaaagtctgagacgggaactagtgatcactagctcaagaactgcaaatgagacaggaagctgttcactgtgaaacagtctcttgcttgtcgtgtatttttcgagtacttctgaagtgtgaagtaaaaaaatctggctaatttatttgtacaaatacactttgataattttttatattttcataaacttttacagatgtaaaattaaagaacttcacttgttctttggagtctgttattccattgtacgtcactacagatttttcactttatagcacagattttttaagttaagaaaacattgagaatgtatcagtttgagatgtttggtgttgaaagccaagtgtccatagaatatatctgcagatattttctatggggacatcagtcaatatacacaaagatgtacattggttcagtctagttaggcaggacaactggaagcaaaggcaggaagactcaaagcagggaggggacttataggttataggtagataagagtcaagtgattgcatccttctgagtttctgattagcattgccagaggaggcagtctagagacgcaggtatctcaga

SEQ ID NO: 419311 - DNA, 3920 bp, Homo sapiens
  misc_feature (789)..(789): n is a, c, g, or t
taatcattctaagaagagccggatgttaatcagacgaggtgcagactctctttggaaagaagaaatcattcgacccgtccgccagagagcctcccgggtccaccgcaggtctcccccaggagcccaaaaccacagcagaggacggggtgccggcacctccgttgttagatccgatcgtccagcagttcggtcagttctcaaaagataaggctctagaggaagaggaggacgacaggccatacgaccctgaggaggagtacgacccggagagggccttcgacactcagcttgtggagcgagggcggcgccacgaggtggaaagggctcctgaagcagctgcagccgagcgggaagaggtggcctatgaccccgaggatgagaccatcttagaagaagcgaaagtgactgttgatgacctgcccaacaggatgtgtgccgacgtgagaaggaactccgtggagaggcctgccgagccggtggccggggctgcgacgccctccctggtggagcaacagaagatgctagaagagctgaacaaacagatcgaggagcagaagagacagctggaggagcaagaagaagctctcaggcagcagagggccgccgtcggggtctccatggcccacttctcggtgtcggacgccttgatgtctccaccaccaaagtcgtccttgcccaaggcagagctgttccagcaagagcagcagtctgcagacaagcccgcctcactgccccccgccagccaggcgtcaaaccacagggacccccggcaggcgaggcgcctggccnctgagaccggtgagggggagggggagcctctctccaggctctcggcacgtggtgcccagggtgccctgcccgagagagatgcttccaggggtggcctcgtgggccaggcgcccatgccagtcccggaggaaaaagagccagcctcttccccctgggcttcgggcgaaaagcccccagcggggtccgagcaggacggctggaaggcagagcctggggagggcacccgccccgccacggttggagacagctcggccaggcctgcccggagggtgctgctgcccacaccgccttgcggcgccctgcagcccggcttcccgctgcagcacgacggtgagagggaccctttcacctgcccggggttcgcgtcgcaggacaaggctctcggctcagcccagtatgaggacccaagaaatcttcattctgctggaaggagcagcagccctgcaggtgaaacagagggggacagagagccacaggccagacccggcgagggcaccgccccgctccccccaccaggacagaaagtggggggctctcagcccccgtttcagggtcagcgggaacctggacctcatgctttggggatgtcagggcttcacggccccaatttcccgggaccaagggggccagcccctccgtttccagaagagaatatcgcttctaacgatgggccacgagggcctccgccagccagattcggagcccagaaggggcccatcccttccttattctcggggcaacatgggccacctccttatggggacagcagaggcccctcaccctcttaccttggtggaccacgaggagtggcaccatcccaatttgaagaacgcaaggatccccatggggagaagagggagttccaggacgccccgtataacgaggtgacgggcgcccccgcccagtttgaagggacagagcaagccccatttctgggaagcagaggcggcgcgcctttccagttcggaggccagagaaggccactgctgtctcagctgaaaggcccccgaggcggcccccctccctctcagtttggaggtcagagaggaccaccccctggtcatttcgtgggcccaagagggccccatcctagtcagtttgaaactgcccggggccctcatcccaaccagtttgaaggacccagaggccaagcgcctaactttatgccaggtcccaggggcattcagcctcagcagttcgaagaccagagggtccattcaccaccaagattcacaaaccaaagggcgcctgcacccctgcagtttggtggactacgggggtccgcacccttttctgaaaaaaatgagcagaccccttcgcgatttcacttccagggccaggccccgcaggtgatgaagccgggccccaggcccctgctggagcttcccagccaccccccgcagcaccggaaggaccgctgggaggaggccgggccgccctccgcgctctcctccagtgcgcccggacagggccccgaggccgacggacagtgggcatcggccgacttccgagaggggaaaggccacgaatacagaaaccagactttcgaagggaggcagagagagcggtttgacgtggggcccaaagagaagccgctggaggagcccgacgcccagggccgggcgtccgaggacaggaggagagagcgcgagcgcggccgaaactggagccgagagcgggactgggaccggccccgggagtgggaccgacaccgggacaaggactccagccgggactgggacagaaaccgggagaggagcgccaaccgcgaccgagagcgcgaggccgaccggggcaaggagtgggaccgcagccgggagcggagcaggaaccgagagcgcgagcgagaccggaggcgcgaccgggaccggtcccggagcagagagcgggaccgagacaaggccagggacagggagcggggccgcgaccgcaaggaccggagcaagagcaaagagagcgctcgggacccgaagcccgaggcctcgagggcctccgacgctggcaccgcctcgcaggcctagacgccccggccgggcagagaccctttttaaagccacgttcgtaagatgcgttgaacaaatagcttttgaaatagccacgatcttagattcaggatagaatattctggacttaaacattactgtaattttgtgtaaatggtttcttacaagatttcacatctttacaattctgatgcttttttaaaaaaactaaactttaatatttccatttaaaattaaaagaaatgggaaattgcctacggagcatattgcttttcagatcatagttatcttttccaataactttattgtaaattttaagggagtttcgttggaccctagagccataccttcactgacatctcatccgtttgtgtttccaaaagctgcttttacaggtcttagccgccgccccggaggccggtgtgggcgtgacctgcaggcgtccaccctgcggctacgggagaagtcttagtagcttgtatctggagtcttgagaaacacaaaccttacaaatgcatctttcttttgtcataaaattggaattacaattttcaactgggaaacagaaacacatttcttagcgtgctcagattttatatatcaccttatcaattttttccaaaacatgatttaaagcaacatctgtcctagtataattgttgcattttaaataacaatttattgaaaaatgttaagttttaccagcctaaaaaaagtaacaaaccaattaagtgtactttgggggcagggaggagtccttgatttgaataatcaggagttttgttggtccagtttcgccttctgagcagttcttctgtatcccgggaaaagtacgctcggccccaaactggtatttgtcagacgatacatgtaaaagtttgtccttgaacgtggaacaagacttgtgtaaagtctgagacgggaactagtgatcactagctcaagaactgcaaatgagacaggaagctgttcactgtgaaacagtctcttgcttgtcgtgtatttttcgagtacttctgaagtgtgaagtaaaaaaatctggctaatttatttgtacaaatacactttgataattttttatattttcataaacttttacagatgtaaaattaaagaacttcacttgtt

SEQ ID NO: 419312 - DNA, 4570 bp, Homo sapiens
  misc_feature (789)..(789): n is a, c, g, or t
taatcattctaagaagagccggatgttaatcagacgaggtgcagactctctttggaaagaagaaatcattcgacccgtccgccagagagcctcccgggtccaccgcaggtctcccccaggagcccaaaaccacagcagaggacggggtgccggcacctccgttgttagatccgatcgtccagcagttcggtcagttctcaaaagataaggctctagaggaagaggaggacgacaggccatacgaccctgaggaggagtacgacccggagagggccttcgacactcagcttgtggagcgagggcggcgccacgaggtggaaagggctcctgaagcagctgcagccgagcgggaagaggtggcctatgaccccgaggatgagaccatcttagaagaagcgaaagtgactgttgatgacctgcccaacaggatgtgtgccgacgtgagaaggaactccgtggagaggcctgccgagccggtggccggggctgcgacgccctccctggtggagcaacagaagatgctagaagagctgaacaaacagatcgaggagcagaagagacagctggaggagcaagaagaagctctcaggcagcagagggccgccgtcggggtctccatggcccacttctcggtgtcggacgccttgatgtctccaccaccaaagtcgtccttgcccaaggcagagctgttccagcaagagcagcagtctgcagacaagcccgcctcactgccccccgccagccaggcgtcaaaccacagggacccccggcaggcgaggcgcctggccnctgagaccggtgagggggagggggagcctctctccaggctctcggcacgtggtgcccagggtgccctgcccgagagagatgcttccaggggtggcctcgtgggccaggcgcccatgccagtcccggaggaaaaagagccagcctcttccccctgggcttcgggcgaaaagcccccagcggggtccgagcaggacggctggaaggcagagcctggggagggcacccgccccgccacggttggagacagctcggccaggcctgcccggagggtgctgctgcccacaccgccttgcggcgccctgcagcccggcttcccgctgcagcacgacggtgagagggaccctttcacctgcccggggttcgcgtcgcaggacaaggctctcggctcagcccagtatgaggacccaagaaatcttcattctgctggaaggagcagcagccctgcaggtgaaacagagggggacagagagccacaggccagacccggcgagggcaccgccccgctccccccaccaggacagaaagtggggggctctcagcccccgtttcagggtcagcgggaacctggacctcatgctttggggatgtcagggcttcacggccccaatttcccgggaccaagggggccagcccctccgtttccagaagagaatatcgcttctaacgatgggccacgagggcctccgccagccagattcggagcccagaaggggcccatcccttccttattctcggggcaacatgggccacctccttatggggacagcagaggcccctcaccctcttaccttggtggaccacgaggagtggcaccatcccaatttgaagaacgcaaggatccccatggggagaagagggagttccaggacgccccgtataacgaggtgacgggcgcccccgcccagtttgaagggacagagcaagccccatttctgggaagcagaggcggcgcgcctttccagttcggaggccagagaaggccactgctgtctcagctgaaaggcccccgaggcggcccccctccctctcagtttggaggtcagagaggaccaccccctggtcatttcgtgggcccaagagggccccatcctagtcagtttgaaactgcccggggccctcatcccaaccagtttgaaggacccagaggccaagcgcctaactttatgccaggtcccaggggcattcagcctcagcagttcgaagaccagagggtccattcaccaccaagattcacaaaccaaagggcgcctgcacccctgcagtttggtggactacgggggtccgcacccttttctgaaaaaaatgagcagaccccttcgcgatttcacttccagggccaggccccgcaggtgatgaagccgggccccaggcccctgctggagcttcccagccaccccccgcagcaccggaaggaccgctgggaggaggccgggccgccctccgcgctctcctccagtgcgcccggacagggccccgaggccgacggacagtgggcatcggccgacttccgagaggggaaaggccacgaatacagaaaccagactttcgaagggaggcagagagagcggtttgacgtggggcccaaagagaagccgctggaggagcccgacgcccagggccgggcgtccgaggacaggaggagagagcgcgagcgcggccgaaactggagccgagagcgggactgggaccggccccgggagtgggaccgacaccgggacaaggactccagccgggactgggacagaaaccgggagaggagcgccaaccgcgaccgagagcgcgaggccgaccggggcaaggagtgggaccgcagccgggagcggagcaggaaccgagagcgcgagcgagaccggaggcgcgaccgggaccggtcccggagcagagagcgggaccgagacaaggccagggacagggagcggggccgcgaccgcaaggaccggagcaagagcaaagagagcgctcgggacccgaagcccgaggcctcgagggcctccgacgctggcaccgcctcgcaggcctagacgccccggccgggcagagaccctttttaaagccacgttcgtaagatgcgttgaacaaatagcttttgaaatagccacgatcttagattcaggatagaatattctggacttaaacattactgtaattttgtgtaaatggtttcttacaagatttcacatctttacaattctgatgcttttttaaaaaaactaaactttaatatttccatttaaaattaaaagaaatgggaaattgcctacggagcatattgcttttcagatcatagttatcttttccaataactttattgtaaattttaagggagtttcgttggaccctagagccataccttcactgacatctcatccgtttgtgtttccaaaagctgcttttacaggtcttagccgccgccccggaggccggtgtgggcgtgacctgcaggcgtccaccctgcggctacgggagaagtcttagtagcttgtatctggagtcttgagaaacacaaaccttacaaatgcatctttcttttgtcataaaattggaattacaattttcaactgggaaacagaaacacatttcttagcgtgctcagattttatatatcaccttatcaattttttccaaaacatgatttaaagcaacatctgtcctagtataattgttgcattttaaataacaatttattgaaaaatgttaagttttaccagcctaaaaaaagtaacaaaccaattaagtgtactttgggggcagggaggagtccttgatttgaataatcaggagttttgttggtccagtttcgccttctgagcagttcttctgtatcccgggaaaagtacgctcggccccaaactggtatttgtcagacgatacatgtaaaagtttgtccttgaacgtggaacaagacttgtgtaaagtctgagacgggaactagtgatcactagctcaagaactgcaaatgagacaggaagctgttcactgtgaaacagtctcttgcttgtcgtgtatttttcgagtacttctgaagtgtgaagtaaaaaaatctggctaatttatttgtacaaatacactttgataattttttatattttcataaacttttacagatgtaaaattaaagaacttcacttgttctttggagtctgttattccattgtacgtcactacagatttttcactttatagcacagattttttaagttaagaaaacattgagaatgtatcagtttgagatgtttggtgttgaaagccaagtgtccataggttaaattacattaaagtaggtgtcacgttccaacatctagtacgatgagaaggttttgtttgtttaacatataaagcaaatttttctaatttaaatacacaaatgtaaaaatcaagtgtgtttctttagtttacttgatagagattcctgtacattgtattttatattgcggaggcttatatcactgtacatgagaacatggaacgacctaggttttgttactcgcagtagaataaacagctacaggaaaaaaaaaaaaaaaaaaaaaaaaaaaaaaaaaacaagcaaacagcagcagcccacaacgaacaaaaccacaacagacgacacagaacagaaacgaccaaacaaaaaaaaaaaaagcagtgctgcgcggcgcaccgcagtacacagagaagagtagtacaaagaccgacgactggatgggcggcggccccgcacagaagagcaaaaacgagtagtagaggattatccagcagagagagagcgcagtgacagccgaggcgtgtggttacacac

SEQ ID NO: 419313 - DNA, 969 bp, Homo sapiens
  misc_feature (915)..(915): n is a, c, g, or t
aagagaggaaagggaagagctaaggctaggtacgaggcctggtgctgagagagagagggttcgaagatggcggcgcgcaagggtcggcgtcgcacgtgtgaaaccggggaacccatggaagccgagtccggcgacacaagttccgagggcccggcccaggtctacctgcccggccgggggccgccgctacgcgaaggggaggagctggtcatggacgaggaggcctatgtgctctaccaccgagcgcagactggcgccccctgtctcagctttgacatagtccgggatcacctgggagacaaccggacagagcttcctcttacactttacttgtgtccccagaacccagttttttgtttgtttgtttgagacggagtcttggtctgtcgcccaggctggagtgcagtagcacgatcttggctcactgcaacctccgcctcctgggttaaagtgattctctcagctcagtctcccaggtagctgggattacaggcatgtgccaccacaccccgttaatttttgtatttttagtagagacggggtttcaccatgttggccaggctggtctcaaattcttgatctcaagtgatctgtccgccccggcctcccagagtgctgggttgggattacaggcgtgagccaccgcgtccggctcaggacccagttttggctgctggttcccagcaggggactcgggggatatacagtggctgcaccaaattggaggtgtgggttcctccaacacaatttgcttctgcccgttgtcttcctgccagctgggtttggccaggatttctccgtgtgggggctacatgcgaccctctcccctcctccctgactttagaggctggtgctgtgtcgggaggaaggtcagggctcctgagcagcaataaaggaccaggaagaggcctgggnggggtaaaaaaaaaaaccgggcttttcggcgcaaagcagacagccgcgtgccgc

SEQ ID NO: 419314 - DNA, 368 bp, Homo sapiens
ttgagcccaggaggttgaggctgcagtgagccattatggcatcactgcactccgtcctgggcaacagagcgggaccctgtctcaaaaacaaaaaagtttgaacggtcaatgcagtaagagtctggagcccaggggagaggtcagggctaggggtattggaaacctcgtggctggactgggtctcctagtgaacaaacacaatttgcttctgcccgttgtcttcctgccagctgggtttggccaggatttctccgtgtgggggctacatgcgaccctctcccctcctccctgactttagaggctggtgctgtgtcgggaggaaggtcagggctcctgagcagcaataaaggaccaggaagaggcctggg

SEQ ID NO: 419315 - DNA, 1781 bp, Homo sapiens
cgcaggcttctttcgctggcgccattacctgagttctcctccagcgtttccgcaccctctccgattagcggtcccaggagtttccaaggtaaccgcgcagtagggcggatctcattaggcggaaagcgaaacccggaagtgacgctcttaccgggtgtcagcagcgagagggttcgaagatggcggcgcgcaagggtcggcgtcgcacgtgtgaaaccggggaacccatggaagccgagtccggcgacacaagttccgagggcccggcccaggtctacctgcccggccgggggccgccgctacgcgaaggggaggagctggtcatggacgaggaggcctatgtgctctaccaccgagcgcagactggcgccccctgtctcagctttgacatagtccgggatcacctgggagacaaccggacagagcttcctcttacactttacttgtgtgctgggacccaggctgagagcgcccagagcaacagactgatgatgcttcggatgcacaatctgcatgggacaaagcccccaccctcagagggcagtgatgaagaagaagaggaggaagatgaagaggatgaagaagagcggaaacctcagctggagctggccatggtgccccactatggtggcatcaaccgagttcgggtgtcatggctgggtgaagagcctgtggctggggtgtggtcagagaagggccaggtggaggtgtttgcgctgcggcggcttctgcaggtggtggaggagccccaggccctggcagccttcctccgggatgagcaggcccaaatgaagcccatcttctccttcgctggacacatgggcgagggctttgcccttgactggtccccccgggtgaccggtcgcctgctgaccggtgactgtcaaaagaacatccacctctggacacctacggacggcggctcctggcacgtggaccagcggccattcgtgggccacacacgctctgtggaggacctgcagtggtcaccgactgagaacacggtgtttgcctcctgctcagctgacgcctccatccgcatctgggacatccgggcagcccccagcaaggcctgcatgctcaccacagccaccgcccatgatggggacgtcaatgtcatcagctggagccgccgggagcccttcctgctcagtggcggggatgatggggccctcaagatctgggaccttcggcagttcaagtctggttccccagtggccaccttcaagcagcacgtggcccccgtgacctccgtcgagtggcacccccaggacagcggggtctttgcagcctcgggtgcagaccaccagatcacacagtgggacctggcagtggagcgggaccctgaggcgggcgacgtggaggccgaccccggactggccgacctcccgcagcagctgctgttcgtgcaccagggcgagaccgagctgaaggagctgcactggcacccgcagtgcccagggctcctggtcagcacggcgctgtcaggcttcaccatcttccgcaccatcagcgtctgaggcgtcccactggctctgatcttgcttcctgcttggaaactgaagtcgaattgggctcccctggaaggggttcattcaggtctgttgactgagactggccggcctgtgggctgccgtgatggattctgtttgacgtattgttctctagaaggcctggctctgatccagtgacccctcctccctgactttagaggctggtgctgtgtcgggaggaaggtcagggctcctgagcagcaataaaggaccaggaagaggcctggg

SEQ ID NO: 419316 - DNA, 1259 bp, Homo sapiens
cgcaggcttctttcgctggcgccattacctgagttctcctccagcgtttccgcaccctctccgattagcggtcccaggagtttccaaggtaaccgcgcagtagggcggatctcattaggcggaaagcgaaacccggaagtgacgctcttaccgggtgtcagcagcgagagggttcgaagatggcggcgcgcaagggtcggcgtcgcacgtgtgaaaccggggaacccatggaagccgagtccggcgacacaagttccgagggcccggcccaggtctacctgcccggccgggggccgccgctacgcgaaggggaggagctggtcatggacgaggaggcctatgtgctctaccaccgagcgcagactggcgccccctgtctcagctttgacatagtccgggatcacctgggagacaaccggacagagcttcctcttacactttacttgtgtgctgggacccaggctgagagcgcccagagcaacagactgatgatgcttcggatgcacaatctgcatgggacaaagcccccaccctcagagggcagtgatgaagaagaagaggaggaagatgaagaggatgaagaagagcggaaacctcagctggagctggccatggtgccccactatggtggcatcaaccgagttcgggtgtcatggctgggtgaagagcctgtggctggggtgtggtcagagaagggccaggtggaggtgtttgcgctgcggcggcttctgcaggtggtggaggagccccaggccctggcagccttcctccgggatgagcaggcccaaatgaagcccatcttctccttcgctggacacatgggcgagggctttgcccttgactggtccccccgggtgaccggtcgcctgctgaccggtgactgtcaaaagaacatccacctctggacacctacggacggcggctcctggcacgtggaccagcggccattcgtgggccacacacgctctgtggaggacctgcagtggtcaccgactgagaacacggtgtttgcctcctgctcagctgacgcctccatccgcatctgggacatccgggcagcccccagcaaggcctgcatgctcaccacagccaccgcccatgatggggacgtcaatgtcatcagctggagccgccgggagcccttcctgctcagtggcggggatgatggggccctcaagatctgggaccttcggcagttcaagtctgttcccagtgggcacttaagcggcgtggcccgtgacctccggagtggcccagag

SEQ ID NO: 419317 - DNA, 486 bp, Homo sapiens
agagtctggagcccaggggagaggtcagggctaggggtattggaaacctcgtggctggactgggtctcctagtgaacaaacacagaggcaaggagatccgaggactgagtcttgtggccttctagcatttagagggttaccgagaccaggagcctgaacaccctcccaagggctggtgggaattgcagcctcaactcccaggcatcctggggctctatcctcccacctcagctcccccacccactcccaccccctgtggagagctgtcccagttaccatgctggtttttgcaggttgtgattttcttcccacagaggtttcaaggagctgtagtcccaggcctgggagatctgaggaagcgcacttctggttctctgggatatggggagcgtggggtcagtgccttgatcctcctctcccctcgcttcacatcacccttcccccaccgctcttctgcaggtgtcatggctgggtgaagagcctgtg

SEQ ID NO: 419318 - DNA, 290 bp, Homo sapiens
cttgcttcctgcttggaaactgaagtcgaattgggctcccctggaaggggttcattcaggtctgttgactgagactggccggcctgtgggctgccgtgatggattctgtttgacgtattgttctctagaaggcctggctctgatccagtgacccctctcaccaaagaactcggtttaaccagggctctgtaagaccactcccacccagagacttgtgtggcctggtgtggcctgtgtgtcggattccttcctgtcagctgtgacccatttgacctgtgtccccagaaccc

SEQ ID NO: 419319 - DNA, 2397 bp, Homo sapiens
cgcaggcttctttcgctggcgccattacctgagttctcctccagcgtttccgcaccctctccgattagcggtcccaggagtttccaaggtaaccgcgcagtagggcggatctcattaggcggaaagcgaaacccggaagtgacgctcttaccgggtgtcagcagcgagagggttcgaagatggcggcgcgcaagggtcggcgtcgcacgtgtgaaaccggggaacccatggaagccgagtccggcgacacaagttccgagggcccggcccaggtctacctgcccggccgggggccgccgctacgcgaaggggaggagctggtcatggacgaggaggcctatgtgctctaccaccgagcgcagactggcgccccctgtctcagctttgacatagtccgggatcacctgggagacaaccggacagagcttcctcttacactttacttgtgtgctgggacccaggctgagagcgcccagagcaacagactgatgatgcttcggatgcacaatctgcatgggacaaagcccccaccctcagagggcagtgatgaagaagaagaggaggaagatgaagaggatgaagaagagcggaaacctcagctggagctggccatggtgccccactatggtggcatcaaccgagttcgggtgtcatggctgggtgaagagcctgtggctggggtgtggtcagagaagggccaggtggaggtgtttgcgctgcggcggcttctgcaggtggtggaggagccccaggccctggcagccttcctccgggatgagcaggcccaaatgaagcccatcttctccttcgctggacacatgggcgagggctttgcccttgactggtccccccgggtgaccggtcgcctgctgaccggtgactgtcaaaagaacatccacctctggacacctacggacggcggctcctggcacgtggaccagcggccattcgtgggccacacacgctctgtggaggacctgcagtggtcaccgactgagaacacggtgtttgcctcctgctcagctgacgcctccatccgcatctgggacatccgggcagcccccagcaaggcctgcatgctcaccacagccaccgcccatgatggggacgtcaatgtcatcagctggagccgccgggagcccttcctgctcagtggcggggatgatggggccctcaagatctgggaccttcggcagttcaagtctggttccccagtggccaccttcaagcagcacgtggcccccgtgacctccgtcgagtggcacccccaggacagcggggtctttgcagcctcgggtgcagaccaccagatcacacagtgggacctggcagtggagcgggaccctgaggcgggcgacgtggaggccgaccccggactggccgacctcccgcagcagctgctgttcgtgcaccagggcgagaccgagctgaaggagctgcactggcacccgcagtgcccagggctcctggtcagcacggcgctgtcaggcttcaccatcttccgcaccatcagcgtctgaggcgtcccactggctctgatcttgcttcctgcttggaaactgaagtcgaattgggctcccctggaaggggttcattcaggtctgttgactgagactggccggcctgtgggctgccgtgatggattctgtttgacgtattgttctctagaaggcctggctctgatccagtgacccctctcaccaaagaactcggtttaaccagggctctgtaagaccactcccacccagagacttgtgtggcctggtgtggcctgtgtgtcggattccttcctgtcagctgtgacccatttgacctgtgtccccagaacccagttttttgtttgtttgtttgagacggagtcttggtctgtcgcccaggctggagtgcagtagcacgatcttggctcactgcaacctccgcctcctgggttaaagtgattctctcagctcagtctcccaggtagctgggattacaggcatgtgccaccacaccccgttaatttttgtatttttagtagagacggggtttcaccatgttggccaggctggtctcaaattcttgatctcaagtgatctgtccgccccggcctcccagagtgctgggttgggattacaggcgtgagccaccgcgtccggctcaggacccagttttggctgctggttcccagcaggggactcgggggatatacagtggctgcaccaaattggaggtgtgggttcctccaacacaatttgcttctgcccgttgtcttcctgccagctgggtttggccaggatttctccgtgtgggggctacatgcgaccctctcccctcctccctgactttagaggctggtgctgtgtcgggaggaaggtcagggctcctgagcagcaataaaggaccaggaagaggcctggg

SEQ ID NO: 419320 - DNA, 1588 bp, Homo sapiens
  misc_feature (1588)..(1588): n is a, c, g, or t
cgcaggcttctttcgctggcgccattacctgagttctcctccagcgtttccgcaccctctccgattagcggtcccaggagtttccaaggtaaccgcgcagtagggcggatctcattaggcggaaagcgaaacccggaagtgacgctcttaccgggtgtcagcagcgagagggttcgaagatggcggcgcgcaagggtcggcgtcgcacgtgtgaaaccggggaacccatggaagccgagtccggcgacacaagttccgagggcccggcccaggtctacctgcccggccgggggccgccgctacgcgaaggggaggagctggtcatggacgaggaggcctatgtgctctaccaccgagcgcagactggcgccccctgtctcagctttgacatagtccgggatcacctgggagacaaccggacagagcttcctcttacactttacttgtgtgctgggacccaggctgagagcgcccagagcaacagactgatgatgcttcggatgcacaatctgcatgggacaaagcccccaccctcagagggcagtgatgaagaagaagaggaggaagatgaagaggatgaagaagagcggaaacctcagctggagctggccatggtgccccactatggtggcatcaaccgagttcgggtgtcatggctgggtgaagagcctgtggctggggtgtggtcagagaagggccaggtggaggtgtttgcgctgcggcggcttctgcaggtggtggaggagccccaggccctggcagccttcctccgggatgagcaggcccaaatgaagcccatcttctccttcgctggacacatgggcgagggctttgcccttgactggtccccccgggtgaccggtcgcctgctgaccggtgactgtcaaaagaacatccacctctggacacctacggacggcggctcctggcacgtggaccagcggccattcgtgggccacacacgctctgtggaggacctgcagtggtcaccgactgagaacacggtgtttgcctcctgctcagctgacgcctccatccgcatctgggacatccgggcagcccccagcaaggcctgcatgctcaccacagccaccgcccatgatggggacgtcaatgtcatcagctggagccgccgggagcccttcctgctcagtggcggggatgatggggccctcaagatctgggaccttcggcagttcaagtctggttccccagtggccaccttcaagcagcacgtggcccccgtgacctccgtcgagtggcacccccaggacagcggggtctttgcagcctcgggtgcagaccaccagatcacacagtgggacctggcagtggagcgggaccctgaggcgggcgacgtggaggccgaccggatggcgaactaccggagagtgtggttctgaacaggcgagaacgatgaagggttggctggaccgagtgcccaggtctgggacaagggctggaagtacacttccgcacacacgttggggccacggctattgtgccctcggaaggagaagggcccgggggccaagtggagaaagggcgggcgaatgtggaaaggggcttgactaacaagaagggaccn

SEQ ID NO: 419321 - DNA, 2000 bp, Homo sapiens
  misc_feature (6)..(7): n is a, c, g, or t
ggcacnngcttcgcagaaacagccagaacccatctacagcaagaagacggaaatccaaaggcagacagtacgggctcccttcgccaaactcttcattttctctgcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaagg

SEQ ID NO: 419322 - DNA, 1628 bp, Homo sapiens
  misc_feature (3)..(3): n is a, c, g, or t
  misc_feature (5)..(8): n is a, c, g, or t
ggnannnncacggggtactcccagctgaaccggctctgaatgtagctaactcaactgtcagaactgcatgaaggacggttcccgtgtcagtggctatgatgacacctcaagttatcactccccagcaaatgcagcagatcctccagcaacaagtgctgagccctcagcagctccaggttctcctccagcagcagcaggccctcatgcttcaacaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaagg

SEQ ID NO: 419323 - DNA, 968 bp, Homo sapiens
gccattcgcaccaacctctcactgcataagtgctttatcagagtagaggatgagtttgggtccttttggacagttgatgatgaagagtttaaacgtggccgccatattcaacgaggccgtcctcgcaaatactgccccgatgaaaactttgacgagcttgtcgcacataacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttgggagtatttttgatttttctactttttgttgaaaaaaggaatttgtactctgtgcattggatggacttgtttggtacttgggattttcctctcttaaccgtcaacatcagtgttgtaaatttgctaaactgattcacttttagcagcagactttgaactgcagtcctgccaacgttggacactgaggacgcccgacagagcttgtgcacctaagctgcagaccaagcctttgcccagaatttaag

SEQ ID NO: 419324 - DNA, 692 bp, Homo sapiens
gtctagaggatcccttcgattggcgggcacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttgggagtatttttgatttttctactttttgttgaaaaaaggaatttgtactctgtgcattggatggacttgtttggtacttgggattttcctctcttaaccgtcaacatcagtgttgtaaatttgctaaactgattcacttttagcagcagactttgaactgcagtcctgccaacgttggacactgaggacgcccgacagagcttgtgcacctaagctgcagaccaagcctttgcccagaatttaag

SEQ ID NO: 419325 - DNA, 716 bp, Homo sapiens
ccactacgggacctgttatctggtactcagtgtggttctaggaccaccggcatcacttgggggcttgttagagatgcagagtctcaggccccaccccagacctgaatcacacactgcatttcaacaaggcccacaggtgactgcagcgtgtgttaaagtatgagaaatgccaccagggaggagaggcccacaccagtccagagactagtgattcagagcatcactacccaagagaactttacgcagtgatgcaaatgttccgtctgtctctgtgctggccagaattaaccgctagtcacatggggcctttgaacataaatgtggctagcacaactcagaaactgaatattaaatgtagtaagatttcgttcatttcaatttaaagagccacgtgtggctaatggtaacaatactggacagagttctagttctagagtgcggcttttctgttgccccaaacttttcagtgcacctgagctgcaatgggctgggaagtaccctcactgaacctctgcatattttttccaggcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaagg

SEQ ID NO: 419326 - DNA, 545 bp, Homo sapiens
ttaaaagccttcctgccatccctctagcagtcactgtaaagttcaaatctcaaagatgcttaggagccaagattctctctgctcgtgcccagcagcccctgctgtgagctcactgccttccccagcacgacctcctaggctgctgccttcctttctgttggagtctggagtcaggctaactcctaaaaatctgcagagaggtctctggagggaggacttcccaagcctgttactacctaagccagaattttacacctagtttccttgaatagagaagtccaaccccagaggtgtgcacacacacccgccctgcaaatcagtgacggggagaaagcctgacttttcttgggttttgctagtgggggaaattgctcatttggaagggcaccagcaagcttaaaacaaaacttagctaggaactcagcagtcgactgtgtttaactttgagtttttatgtttttcttacacagtaacccttcccttattaaaaacatgcagagcagccacgcctactgcacaccaagtggttccttgtcgggtaccga

SEQ ID NO: 419327 - DNA, 464 bp, Homo sapiens
tcgagctttgtaccctgtcgctgtgtctacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttgggagtatttttgatttttctactttttgttgaaaaaaggaatttgtactctgtgcattggatggacttgtttggtacttgggattttcctctcttaaccgtcaacatcagtgttgtaaatttgctaaactgattcacttttagcagcagactttgaactgcagtcctgccaacgttggacactgaggacgcccgacagagcttgtgcacctaagctgcagaccaagcctttgcccagaatttaag

SEQ ID NO: 419328 - DNA, 582 bp, Homo sapiens
aggtaatgattgcattgtcttcccgggtaagtcgaggcggccgcgggcgcggggtccagggacaccggagagccccaggcggcactaggggttctccgtccccaaagagccagccggggtggcgcgagcctagcgataaggcaccgggagcgaggaatgtgcccatcctcaggccgtgtcccagaagcttttgttgacaattccagtttccgaacaaaacatttcggcaatggtgagggcttcgatcccttctctgatttgctgtcagccatgaacggatggatgtgatgcctgctagccaaaagggtgagtgaatgaatgtttgtgattattcatctgaaaattcacaagacaaaaagtccttcaagacagttgcccacccaggatgagagattcttatcttgaaagaagggacaaactctgtcattgttttctggtgtaatcttttcagataattcctgcggtgatctgaggatttataaaaggcataataggacataggataacttcctctgttggcttgtttgttttaatcatactctgaaggatggactatctcagttttggtccatgtgcaacgtt

SEQ ID NO: 419329 - DNA, 342 bp, Homo sapiens
aattttacacttaatcgcgatctcgcgatcagtgttttgtgttcacctgtctgtccatctgtctttctgtctgtcagtggcatctcataaaccatcagccctctaggagtcccagcagttggcttaagagactaatttcaagcccttgggagttggaagtcctgcaggtccccttgtggggagcagttgctgagacgaagatgagtggacctgtgtgtcagcctaacccttccccattttgaataaaattattctttggagaaatggttcccactgctttcatgcaaaaataaaaattaaacgaaaaacagcttaagcctgtgaagaaggaaataagagcta

SEQ ID NO: 419330 - DNA, 2607 bp, Homo sapiens
aggaggggggtgggcgccagcgccccggcgaacggcaaagagggagccgctcccgctcggggggccgctggagtgcccagcgggaacccgaaagtttgtaagaggaagagagcgcgcggcgagcgagcgagcgggccgggggcagcggcagcggcgccggggaccatggtgctgccggcgcctcctccgcgggcgtgaaggcggcgctcctactccctccccggactccgcggtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaagg

SEQ ID NO: 419331 - DNA, 2255 bp, Homo sapiens
  misc_feature (6)..(6): n is a, c, g, or t
cccggncccggggaattccccgggagtctagagacttagaagcatttattaacagtgaggctgctgaaggtttttaataacaaaattacaaatactctatctaattggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaagg

SEQ ID NO: 419332 - DNA, 1884 bp, Homo sapiens
tcctctgcaccttccaagacctccttaataatgaacccacatgcctctaccaatggacagctctcagtccacactcccaaaagggaaaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaagg

SEQ ID NO: 419333 - DNA, 2983 bp, Homo sapiens
aggaggggggtgggcgccagcgccccggcgaacggcaaagagggagccgctcccgctcggggggccgctggagtgcccagcgggaacccgaaagtttgtaagaggaagagagcgcgcggcgagcgagcgagcgggccgggggcagcggcagcggcgccggggaccatggtgctgccggcgcctcctccgcgggcgtgaaggcggcgctcctactccctccccggactccgcggtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttgggagtatttttgatttttctactttttgttgaaaaaaggaatttgtactctgtgcattggatggacttgtttggtacttgggattttcctctcttaaccgtcaacatcagtgttgtaaatttgctaaactgattcacttttagcagcagactttgaactgcagtcctgccaacgttggacactgaggacgcccgacagagcttgtgcacctaagctgcagaccaagcctttgcccagaatttaag

SEQ ID NO: 419334 - DNA, 2814 bp, Homo sapiens
  misc_feature (2421)..(2421): n is a, c, g, or t
aggaggggggtgggcgccagcgccccggcgaacggcaaagagggagccgctcccgctcggggggccgctggagtgcccagcgggaacccgaaagtttgtaagaggaagagagcgcgcggcgagcgagcgagcgggccgggggcagcggcagcggcgccggggaccatggtgctgccggcgcctcctccgcgggcgtgaaggcggcgctcctactccctccccggactccgcggtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgnatcctgtacacgtccggaagagacccgccaggttctgataagaaccccggggaggagaaagccgaggaagagggagttgctgaagaggagggagttaaccagttctcttatccaccatcacaccgggagtgttgtcccgccgtggaggaggaggacgatgaagaagctgtaaagaaagaagctcacagaacctctacttctgccttgtctccaggatccaagcccagcacttgggtgtcttgccccggggaggaagagaatcaagccacggaggataaaagaacagaaagaagtaaaggagcccggaagacctccgtgtccccccgatcttcaggctccgaccccaggtcctgggagtatcggtcgaagagacccgcaggggatcctctaggt

SEQ ID NO: 419335 - DNA, 1412 bp, Homo sapiens
aggaggggggtgggcgccagcgccccggcgaacggcaaagagggagccgctcccgctcggggggccgctggagtgcccagcgggaacccgaaagtttgtaagaggaagagagcgcgcggcgagcgagcgagcgggccgggggcagcggcagcggcgccggggaccatggtgctgccggcgcctcctccgcgggcgtgaaggcggcgctcctactccctccccggactccgcggtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaagactttgcatttcctagaatttctgtttgtcagttctcaatttcctgtgtttgcaatgttgaaattttttggtgaagtactgaacttgctttttttccggtttttacatgcaaaaatgaatttaaactgccatcttacgactattttttctttttaaaacacttaactcaggccattttttaagttggttacttcaaagtaaataaactttaaaattca

SEQ ID NO: 419336 - DNA, 1045 bp, Homo sapiens
aggaggggggtgggcgccagcgccccggcgaacggcaaagagggagccgctcccgctcggggggccgctggagtgcccagcgggaacccgaaagtttgtaagaggaagagagcgcgcggcgagcgagcgagcgggccgggggcagcggcagcggcgccggggaccatggtgctgccggcgcctcctccgcgggcgtgaaggcggcgctcctactccctccccggactccgcggtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggtaacaattctttttctttttaaattgacattataccctttgggataagtgacaagcagttcaggagtggattgtgttgagcattgcaaatcatgtaagaaaatcttctgtggaaagtgcatttttggtttaccagcaagttgtaacattttggggaaaatgtgtatttgaccaaaagttttattgtcaggagtaagatctgctgattagtgaatataatagaaggataagga

SEQ ID NO: 419337 - DNA, 1092 bp, Homo sapiens
ccactacgggacctgttatctggtactcagtgtggttctaggaccaccggcatcacttgggggcttgttagagatgcagagtctcaggccccaccccagacctgaatcacacactgcatttcaacaaggcccacaggtgactgcagcgtgtgttaaagtatgagaaatgccaccagggaggagaggcccacaccagtccagagactagtgattcagagcatcactacccaagagaactttacgcagtgatgcaaatgttccgtctgtctctgtgctggccagaattaaccgctagtcacatggggcctttgaacataaatgtggctagcacaactcagaaactgaatattaaatgtagtaagatttcgttcatttcaatttaaagagccacgtgtggctaatggtaacaatactggacagagttctagttctagagtgcggcttttctgttgccccaaacttttcagtgcacctgagctgcaatgggctgggaagtaccctcactgaacctctgcatattttttccaggcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttgggagtatttttgatttttctactttttgttgaaaaaaggaatttgtactctgtgcattggatggacttgtttggtacttgggattttcctctcttaaccgtcaacatcagtgttgtaaatttgctaaactgattcacttttagcagcagactttgaactgcagtcctgccaacgttggacactgaggacgcccgacagagcttgtgcacctaagctgcagaccaagcctttgcccagaatttaag

SEQ ID NO: 419338 - DNA, 436 bp, Homo sapiens
  misc_feature (144)..(144): n is a, c, g, or t
cgagattatgccactgcactccagcctgggcgccagagcgagactctgtctcaaaaaaaaaaagaaaaaagaaaaatttaatcttgaattctaggtttacttacaaatactagtttttctaagggtaaaaaagtaatatatttnaaacaatactactgaaacttgaattgggaatgacagtttcagacccgaaactaggggcatggccactaatgaggggataagttgagtgaaagaaaatgacaactgtttacagattttggcaacatttaaaccaaggcccttctccttatgcacaacaactgctttaacagctgctttttttttctccccccctccctccccccatcttggaaatccttgtatcaggtttttgagtcatgatgcaagaatctgggactgagacaaaaagtaacggttcagccatccagaatgg

SEQ ID NO: 419339 - DNA, 502 bp, Homo sapiens
acggagagacgccggccgtggacatcggggcagctgacctcgcccacgcccagcagcagcagcaacaggtactgggctttggagtcttgggaggtggaggtggtgggtgcgaattttactgctgaattttacacttaatcgcgatctcgcgatcagtgttttgtgttcacctgtctgtccatctgtctttctgtctgtcagtggcatctcataaaccatcagccctctaggagtcccagcagttggcttaagagactaatttcaagcccttgggagttggaagtcctgcaggtccccttgtggggagcagttgctgagacgaagatgagtggacctgtgtgtcagcctaacccttccccattttgaataaaattattctttggagaaatggttcccactgctttcatgcaaaaataaaaattaaacgaaaaacagcttaagcctgtgaagaaggaaataagagctaaggaataaaagagagaaaaagagtagatgagtaagg

SEQ ID NO: 419340 - DNA, 1772 bp, Homo sapiens
  misc_feature (6)..(7): n is a, c, g, or t
ggcacnngcttcgcagaaacagccagaacccatctacagcaagaagacggaaatccaaaggcagacagtacgggctcccttcgccaaactcttcattttctctgcacttcaggtggcaagacagctccttcttcagcagcaacagcagcagcaagttagtggattaaaatctcccaagaggaatgacaaacaaccagctcttcagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaagg

SEQ ID NO: 419341 - DNA, 893 bp, Homo sapiens
aggaggggggtgggcgccagcgccccggcgaacggcaaagagggagccgctcccgctcggggggccgctggagtgcccagcgggaacccgaaagtttgtaagaggaagagagcgcgcggcgagcgagcgagcgggccgggggcagcggcagcggcgccggggaccatggtgctgccggcgcctcctccgcgggcgtgaaggcggcgctcctactccctccccggactccgcggtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacagtggcatctcataaaccatcagccctctaggagtcccagcagttggcttaagagactaatttcaagcccttgggagttggaagtcctgcaggtccccttgtggggagcagttgctgagacgaagatgagtggacctgtgtgtcagcctaacccttccccattttgaataaaattattctttgga

SEQ ID NO: 419342 - DNA, 422 bp, Homo sapiens
cataattagtagtttccttgtcttacataccctgtgtcttcataaattttctcttggttgatgacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaagg

SEQ ID NO: 419343 - DNA, 511 bp, Homo sapiens
tgaacattttcaagatttcttggccagtcgcaaatcctcaagcatccaggaaatggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacagtggcatctcataaaccatcagccctctaggagtcccagcagttggcttaagagactaatttcaagcccttgggagttggaagtcctgcaggtccccttgtggggagcagttgctgagacgaagatgagtggacctgtgtgtcagcctaacccttccccattttgaataaaattattctttggagaaatggttcccactgctttcatgcaaaaataaaaattaaacgaaaaacagcttaagcctgtgaagaaggaaataagagcta

SEQ ID NO: 419344 - DNA, 1899 bp, Homo sapiens
agcggagtccgcctgcacgccgaggccgccggaccccacgcccggcccgcgcgggcgccccgagcccggctccgcgcgcctggcggctacatggagagtgtcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaagg

SEQ ID NO: 419345 - DNA, 2012 bp, Homo sapiens
tggttttcctgaccgcccactttcatggcgcccaggctgtgtgccttttgatactgcaacgcagagcagctgcaggggatgctaataaaatgcaggattttggacactgagcaaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaagg

SEQ ID NO: 419346 - DNA, 1335 bp, Homo sapiens
cttaggaatggccagaaaggacttttaaccataagcaagatatgtctgcagaaaccatcaactgtaggaatatagtcattttgccattgagagttccactcgtgttcctttggcatttactcagttaaaatacttgccgatagttagggccaactctcatattctggaaggtgagacataacatgatagctactgatctcttgaccggggcggggcggggcgggggcggggggtccgttcaccaccccccgatcctttgactatacaaggcgatactctcaacggtaaaatccactttagaattcttcataggacctctggaagttttaaaagccagaagccatcaagaacaaaactgtatttagcagtattaaccaagtgttcctctttcgtggtttgaaaaaaataccccctttttatgggaggtaggtgggcttaaaaagggcagtttcatactttgcatgtgttgttttgaagtcacagtaacattttcagatttgtactctggaacctattttgggcttgtatgcatattaaaaaatatttctgctggtcagttattaccagagactagacgaaaatgccaaagtacgattaatttataattttggtttatttttgcttttggaaaagacatccttaaccatgagaaggtcctccacgggggtggtagctacagctcttggggatggttttacaaatgtggactgttaggctgaatttactgctgtttttggagtcttttcttatagaaaatgtaaatgttctctcttttatacttgctgcagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaagg

SEQ ID NO: 419347 - DNA, 895 bp, Homo sapiens
ttaaaagccttcctgccatccctctagcagtcactgtaaagttcaaatctcaaagatgcttaggagccaagattctctctgctcgtgcccagcagcccctgctgtgagctcactgccttccccagcacgacctcctaggctgctgccttcctttctgttggagtctggagtcaggctaactcctaaaaatctgcagagaggtctctggagggaggacttcccaagcctgttactacctaagccagaattttacacctagtttccttgaatagagaagtccaaccccagaggtgtgcacacacacccgccctgcaaatcagtgacggggagaaagcctgacttttcttgggttttgctagtgggggaaattgctcatttggaagggcaccagcaagcttaaaacaaaacttagctaggaactcagcagtcgactgtgtttaactttgagtttttatgtttttcttacacagtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaagg

SEQ ID NO: 419348 - DNA, 975 bp, Homo sapiens
aggaggggggtgggcgccagcgccccggcgaacggcaaagagggagccgctcccgctcggggggccgctggagtgcccagcgggaacccgaaagtttgtaagaggaagagagcgcgcggcgagcgagcgagcgggccgggggcagcggcagcggcgccggggaccatggtgctgccggcgcctcctccgcgggcgtgaaggcggcgctcctactccctccccggactccgcggtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacagtggcatctcataaaccatcagccctctaggagtcccagcagttggcttaagagactaatttcaagcccttgggagttggaagtcctgcaggtccccttgtggggagcagttgctgagacgaagatgagtggacctgtgtgtcagcctaacccttccccattttgaataaaattattctttggagaaatggttcccactgctttcatgcaaaaataaaaattaaacgaaaaacagcttaagcctgtgaagaaggaaataagagcta

SEQ ID NO: 419349 - DNA, 464 bp, Homo sapiens
gagccccaggcggcactaggggttctccgtccccaaagagccagccggggtggcgcgagcctagcgataaggcaccgggagcgaggaatgtgcccatcctcaggccggtaggtgcttcgaaatactggacttcctcccctccacccttttcccctctttctttcctaaatctgaaaatctggagatcaaagtttagcgtggagtgtaaagtgctccgataaaatatggtgacatcctcgccccccttctcaccccactcccctcttataactattaattatttccaagtcattgtatccaaatacccttgctgggctgattacaaagtgtattgatttagtctgggctcatcctatgctttcgtcttaattcattttctttttgctctaccagaagacccaaaatgaaacttatttcttcctcttccctacctccccaccccacaagccctcatctgtgaggct

SEQ ID NO: 419350 - DNA, 1397 bp, Homo sapiens
tcgcctgtgtacctttgtactttctacagtgaaagttgctacaggatctccctttctcaataaattcatctgcggtggagaaaatcagcatgagtactacaggccaagtcatcagatgcaaagcagccatactctggaagcctggtgcaccattttctattgaagaggtagaagtggccccaccaaaggcaaaggaagttcgcataaaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccaggtgacaaagttatcacactctttctgccacagtgtggagaatgtacctcttgcctgaattctgagggcaatttttgtatacaattcaaacagtcaaaaacccaactgatgtctgatggtaccagcaggtttacctgcaagggaaaatcaatatatcactttggtaataccagcaccttctgtgaatacacagtgataaaggaaatctcagttgccaagattgatgcagtcgctcctctagagaaagtatgcctaattagctgtggcttttccactgggtttggtgctgcaatcaatactgccaaggtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggcagctgccctcgcctcctgcaatgagagctatggggtctgtgtggttgttggggtgttgcctgccagtgttcaactcaaaatcagtggccagttgttcttctcaggacgttctttgaagggttctgtttttggaggctggaagagcagacagcacatccctaaactggttgctgattatatggcagagaagttgaatctagatccactaattactcatactctgaatcttgataaaatcaatgaagcagttgaattaatgaaaactggaaaatgtggtaaactgcccacataaattttatgtctgtgtgtttgagaccaagagaaagggtgtattggcttgggagtagaagaagggtcgtccctgctgcagaagctgtatactgataattgaagaggctttcaggaatttgtaaagcatctccttcccctctgcattttgttttatttctagctaataaaatacataatcctgaaagta

SEQ ID NO: 419351 - DNA, 2754 bp, Homo sapiens
tcgcctgtgtacctttgtactttctacagtgaaagttgctacaggatctccctttctcaataaattcatctgcggtggagaaaatcagcatgagtactacaggccaagtcatcagatgcaaagcagccatactctggaagcctggtgcaccattttctattgaagaggtagaagtggccccaccaaaggcaaaggaagttcgcataaaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccaggtgacaaagttatcacactctttctgccacagtgtggagaatgtacctcttgcctgaattctgagggcaatttttgtatacaattcaaacagtcaaaaacccaactgatgtctgatggtaccagcaggtttacctgcaagggaaaagaaatctcagttgccaagattgatgcagtcgctcctctagagaaagtatgcctaattagctgtggcttttccactgggtttggtgctgcaatcaatactgccaaggtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggcagctgccctcgcctcctgcaatgagagctatggggtctgtgtggttgttggggtgttgcctgccagtgttcaactcaaaatcagtggccagttgttcttctcaggacgttctttgaagggttctgtttttggaggctggaagagcagacagcacatccctaaactggttgctgattatatggcagagaagttgaatctagatccactaattactcatactctgaatcttgataaaatcaatgaagcagttgaattaatgaaaactggaaaatgtatccgctgtatcctgttactttaagtacaatgtaatacatgcaagacccaaaggatatttcaccaactcaatggcatttgatgtaattttcatgatttagaagaattattcacccaatcccatttctatattctgacttctgattcactccgcagtggacctatatctggcttctgacctaaccatttcatcaaaattgttcttacgtaacccagtgtcaccaaggatcagcctccttttcagagctagattaaggttggcttgaatcactcaactccacatccttcagacataaaaggtcaatgcaagatgctcccattttcatagttcctctacctgtggacctttatattcttgtacactatatgtctctctcacaggcctagacatgaaactctgccattttactctaaagaaacaaaactccgcattaatgagtttattgaagattcaggttaacctgaatcaagttaacccagtctcaaatgctcacttatcctatctccttggcacaaatctctcctctcctggattgccaaagaaaattcaaattattcttcaattagtcaggatgatttgactatcagcagttcatagtacccatcttcataactaagccacctagggatccagcagaaaaaaaagggatgaggggagtcatcatacaggaggtggatcatttaccaggatccacacttcctacaaagcggttgtaatattaaataacaaaactgttttttattccaatcttcacataaaacaggaataattgtatactttcttactaatgtgttccatggagtttttcctccaagaagtggcttaggggaaaatgagccccagtaatgctttgtggcatccaatccttctaccccgaccctttgactttctgccccagcccctcttagttctcctagaattaggactaaggttaagtgccctcttgggatatgacttccttcccttcctcttgatacaaaaagagcctattaccaaccctcatacacacaagagttcccttcctagttgcagactcttctgctccagctggactcccctagctctggactcccactagatcacacaggggtccctgcatgtcagtaaactttggatgaccttgggagaccaaaaaatggaatatcattttttgatctaaacaaaatagtttcctgatttaacactggccaggaaggtgggctgcaccctcagtctctctctcccatcatggttttcacatgatatcaaaggactctcataacagtctgattcttatgagttgggcatcctgtgtttccctttaggggcctgcttccttcaaatagaggagatgggtgctatgaaacctattcactctggacttgggatggctcttctccatcttcccaagtctgagctggagcctccatgcccaactctgctctgctcttctatttcctgacagcagctaaggcatgttcctgttctgcccccaaattgaccttactaacagtgagaacttggaggagtcttcgggtcttgggaaatccaagttttcccggaaacgttttgttgtaaacagtgtccacactctttgctccaataaagctcggttccttaagccactttgaatgtc

SEQ ID NO: 419352 - DNA, 2808 bp, Homo sapiens
tcgcctgtgtacctttgtactttctacagtgaaagttgctacaggatctccctttctcaataaattcatctgcggtggagaaaatcagcatgagtactacaggccaagtcatcagatgcaaagcagccatactctggaagcctggtgcaccattttctattgaagaggtagaagtggccccaccaaaggcaaaggaagttcgcataaaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccaggtgacaaagttatcacactctttctgccacagtgtggagaatgtacctcttgcctgaattctgagggcaatttttgtatacaattcaaacagtcaaaaacccaactgatgtctgatggtaccagcaggtttacctgcaagggaaaatcaatatatcactttggtaataccagcaccttctgtgaatacacagtgataaaggaaatctcagttgccaagattgatgcagtcgctcctctagagaaagtatgcctaattagctgtggcttttccactgggtttggtgctgcaatcaatactgccaaggtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggcagctgccctcgcctcctgcaatgagagctatggggtctgtgtggttgttggggtgttgcctgccagtgttcaactcaaaatcagtggccagttgttcttctcaggacgttctttgaagggttctgtttttggaggctggaagagcagacagcacatccctaaactggttgctgattatatggcagagaagttgaatctagatccactaattactcatactctgaatcttgataaaatcaatgaagcagttgaattaatgaaaactggaaaatgtatccgctgtatcctgttactttaagtacaatgtaatacatgcaagacccaaaggatatttcaccaactcaatggcatttgatgtaattttcatgatttagaagaattattcacccaatcccatttctatattctgacttctgattcactccgcagtggacctatatctggcttctgacctaaccatttcatcaaaattgttcttacgtaacccagtgtcaccaaggatcagcctccttttcagagctagattaaggttggcttgaatcactcaactccacatccttcagacataaaaggtcaatgcaagatgctcccattttcatagttcctctacctgtggacctttatattcttgtacactatatgtctctctcacaggcctagacatgaaactctgccattttactctaaagaaacaaaactccgcattaatgagtttattgaagattcaggttaacctgaatcaagttaacccagtctcaaatgctcacttatcctatctccttggcacaaatctctcctctcctggattgccaaagaaaattcaaattattcttcaattagtcaggatgatttgactatcagcagttcatagtacccatcttcataactaagccacctagggatccagcagaaaaaaaagggatgaggggagtcatcatacaggaggtggatcatttaccaggatccacacttcctacaaagcggttgtaatattaaataacaaaactgttttttattccaatcttcacataaaacaggaataattgtatactttcttactaatgtgttccatggagtttttcctccaagaagtggcttaggggaaaatgagccccagtaatgctttgtggcatccaatccttctaccccgaccctttgactttctgccccagcccctcttagttctcctagaattaggactaaggttaagtgccctcttgggatatgacttccttcccttcctcttgatacaaaaagagcctattaccaaccctcatacacacaagagttcccttcctagttgcagactcttctgctccagctggactcccctagctctggactcccactagatcacacaggggtccctgcatgtcagtaaactttggatgaccttgggagaccaaaaaatggaatatcattttttgatctaaacaaaatagtttcctgatttaacactggccaggaaggtgggctgcaccctcagtctctctctcccatcatggttttcacatgatatcaaaggactctcataacagtctgattcttatgagttgggcatcctgtgtttccctttaggggcctgcttccttcaaatagaggagatgggtgctatgaaacctattcactctggacttgggatggctcttctccatcttcccaagtctgagctggagcctccatgcccaactctgctctgctcttctatttcctgacagcagctaaggcatgttcctgttctgcccccaaattgaccttactaacagtgagaacttggaggagtcttcgggtcttgggaaatccaagttttcccggaaacgttttgttgtaaacagtgtccacactctttgctccaataaagctcggttccttaagccactttgaatgtc

SEQ ID NO: 419353 - DNA, 2700 bp, Homo sapiens
tcgcctgtgtacctttgtactttctacagtgaaagttgctacaggatctccctttctcaataaattcatctgcggtggagaaaatcagcatgagtactacaggccaagtcatcagatgcaaagcagccatactctggaagcctggtgcaccattttctattgaagaggtagaagtggccccaccaaaggcaaaggaagttcgcataaaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccaggtgacaaagttatcacactctttctgccacagtgtggagaatgtacctcttgcctgaattctgagggcaatttttgtatacaattcaaacagtcaaaaacccaactgatgtctgatggtaccagcaggtttacctgcaagggaaaagaaatctcagttgccaagattgatgcagtcgctcctctagagaaagtatgcctaattagctgtggcttttccactgggtttggtgctgcaatcaatactgccaaggtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggcagctgccctcgcctcctgcaatgagagctatggggtctgtgtggttgttggggtgttgcctgccagtgttcaactcaaaatcagtggccagttgttcttctcaggacgttctttgaagggttctgtttttggaggctggaagagcagacagcacatccctaaactggttgctgattatatggcagagaagttgaatctagatccactaattactcatactctgaatcttgataaaatcaatgaagcagttgaattaatgaaaactggaaaatgtatccgctgtatcctgttactttaagtacaatgtaatacatgcaagacccaaaggatatttcaccaactcaatggcatttgatgtaattttcatgatttagaagaattattcacccaatcccatttctatattctgacttctgattcactccgcagtggacctatatctggcttctgacctaaccatttcatctagattaaggttggcttgaatcactcaactccacatccttcagacataaaaggtcaatgcaagatgctcccattttcatagttcctctacctgtggacctttatattcttgtacactatatgtctctctcacaggcctagacatgaaactctgccattttactctaaagaaacaaaactccgcattaatgagtttattgaagattcaggttaacctgaatcaagttaacccagtctcaaatgctcacttatcctatctccttggcacaaatctctcctctcctggattgccaaagaaaattcaaattattcttcaattagtcaggatgatttgactatcagcagttcatagtacccatcttcataactaagccacctagggatccagcagaaaaaaaagggatgaggggagtcatcatacaggaggtggatcatttaccaggatccacacttcctacaaagcggttgtaatattaaataacaaaactgttttttattccaatcttcacataaaacaggaataattgtatactttcttactaatgtgttccatggagtttttcctccaagaagtggcttaggggaaaatgagccccagtaatgctttgtggcatccaatccttctaccccgaccctttgactttctgccccagcccctcttagttctcctagaattaggactaaggttaagtgccctcttgggatatgacttccttcccttcctcttgatacaaaaagagcctattaccaaccctcatacacacaagagttcccttcctagttgcagactcttctgctccagctggactcccctagctctggactcccactagatcacacaggggtccctgcatgtcagtaaactttggatgaccttgggagaccaaaaaatggaatatcattttttgatctaaacaaaatagtttcctgatttaacactggccaggaaggtgggctgcaccctcagtctctctctcccatcatggttttcacatgatatcaaaggactctcataacagtctgattcttatgagttgggcatcctgtgtttccctttaggggcctgcttccttcaaatagaggagatgggtgctatgaaacctattcactctggacttgggatggctcttctccatcttcccaagtctgagctggagcctccatgcccaactctgctctgctcttctatttcctgacagcagctaaggcatgttcctgttctgcccccaaattgaccttactaacagtgagaacttggaggagtcttcgggtcttgggaaatccaagttttcccggaaacgttttgttgtaaacagtgtccacactctttgctccaataaagctcggttccttaagccactttgaatgtc

SEQ ID NO: 419354 - DNA, 2700 bp, Homo sapiens
tcgcctgtgtacctttgtactttctacagtgaaagttgctacaggatctccctttctcaataaattcatctgcggtggagaaaatcagcatgagtactacaggccaagtcatcagatgcaaagcagccatactctggaagcctggtgcaccattttctattgaagaggtagaagtggccccaccaaaggcaaaggaagttcgcataaaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccaggtgacaaagttatcacactctttctgccacagtgtggagaatgtacctcttgcctgaattctgagggcaatttttgtatacaattcaaacagtcaaaaacccaactgatgtctgatggtaccagcaggtttacctgcaagggaaaagaaatctcagttgccaagattgatgcagtcgctcctctagagaaagtatgcctaattagctgtggcttttccactgggtttggtgctgcaatcaatactgccaaggtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggcagctgccctcgcctcctgcaatgagagctatggggtctgtgtggttgttggggtgttgcctgccagtgttcaactcaaaatcagtggccagttgttcttctcaggacgttctttgaagggttctgtttttggaggctggaagagcagacagcacatccctaaactggttgctgattatatggcagagaagttgaatctagatccactaattactcatactctgaatcttgataaaatcaatgaagcagttgaattaatgaaaactggaaaatgtatccgctgtatcctgttactttaagtacaatgtaatacatgcaagacccaaaggatatttcaccaactcaatggcatttgatgtaattttcatgatttagaagaattattcacccaatcccatttctatattctgacttctgattcactccgcagtggacctatatctggcttctgacctaaccatttcatcaaaattgttcttacgtaacccagtgtcaccaaggatcagcctccttttcagagctagattaaggttggcttgaatcactcaactccacatccttcagacataaaaggtcaatgcaagatgctcccattttcatagttcctctacctgtggacctttatattcttgtacactatatgtctctctcacaggcctagacatgaaactctgccattttactctaaagaaacaaaactccgcattaatgagtttattgaagattcaggttaacctgaatcaagttaacccagtctcaaatgctcacttatcctatctccttggcacaaatctctcctctcctggattgccaaagaaaattcaaattattcttcaattagtcaggatgatttgactatcagcagttcatagtacccatcttcataactaagccacctagggatccagcagaaaaaaaagggatgaggggagtcatcatacaggaggtggatcatttaccaggatccacacttcctacaaagcggttgtaatattaaataacaaaactgttttttattccaatcttcacataaaacaggaataattgtatactttcttactaatgtgttccatggagtttttcctccaagaagtggcttaggggaaaatgagccccagtaatgctttgtggcatccaatccttctaccccgaccctttgactttctgccccagcccctcttagttctcctagaattaggactaaggttaagtgccctcttgggatatgacttccttcccttcctcttgatacaaaaagagcctattaccaaccctcatacacacaagagttcccttcctagttgcagactcttctgctccagctggactcccctagctctggactcccactagatcacacaggggtccctgcatgtcagtaaactttggatgaccttgggagaccaaaaaatggaatatcattttttgatctaaacctctctcccatcatggttttcacatgatatcaaaggactctcataacagtctgattcttatgagttgggcatcctgtgtttccctttaggggcctgcttccttcaaatagaggagatgggtgctatgaaacctattcactctggacttgggatggctcttctccatcttcccaagtctgagctggagcctccatgcccaactctgctctgctcttctatttcctgacagcagctaaggcatgttcctgttctgcccccaaattgaccttactaacagtgagaacttggaggagtcttcgggtcttgggaaatccaagttttcccggaaacgttttgttgtaaacagtgtccacactctttgctccaataaagctcggttccttaagccactttgaatgtc

SEQ ID NO: 419355 - DNA, 407 bp, Homo sapiens
aggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggtatgtaatcctctggagtgaaaattaccaatacttttaccagtcatcgtttagattatagttgaatgagctttctaaaattccctccactttgctctatttaattttccttgtgttccatgacatctcagctggtgccgtctgtgtactcttacaaatttgttcactatcccagatactaaatctagaactttcatataatttcaaagccagaagttttaagcaagataagattaaaatttgattaatgaccttata

SEQ ID NO: 419356 - DNA, 538 bp, Homo sapiens
tcgcctgtgtacctttgtactttctacagtgaaagttgctacaggatctccctttctcaataaattcatctgcggtggagaaaatcagcatgagtactacaggccaagtcatcagatgcaaagcagccatactctggaagcctggtgcaccattttctattgaagaggtagaagtggccccaccaaaggcaaaggaagttcgcataaaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccaggtgacaaagttatcacactctttctgccacagtgtggagaatgtacctcttgcctgaattctgagggcaatttttgtatacaattcaacagtacccaactggtgtttgatgtaccagcagggttaacttgcagggaaactagttgcaagatcgtgcagtcgctccttagagggaaccttggcgggcg

SEQ ID NO: 419357 - DNA, 2672 bp, Homo sapiens
tcgcctgtgtacctttgtactttctacagtgaaagttgctacaggatctccctttctcaataaattcatctgcggtggagaaaatcagcatgagtactacaggccaagtcatcagatgcaaagcagccatactctggaagcctggtgcaccattttctattgaagaggtagaagtggccccaccaaaggcaaaggaagttcgcataaaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccaggtgacaaagttatcacactctttctgccacagtgtggagaatgtacctcttgcctgaattctgagggcaatttttgtatacaattcaaacagtcaaaaacccaactgatgtctgatggtaccagcaggtttacctgcaagggaaaatcaatatatcactttggtaataccagcaccttctgtgaatacacagtgataaaggaaatctcagttgccaagattgatgcagtcgctcctctagagaaagtatgcctaattagctgtggcttttccactgggtttggtgctgcaatcaatactgccaaggtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggctggaagagcagacagcacatccctaaactggttgctgattatatggcagagaagttgaatctagatccactaattactcatactctgaatcttgataaaatcaatgaagcagttgaattaatgaaaactggaaaatgtatccgctgtatcctgttactttaagtacaatgtaatacatgcaagacccaaaggatatttcaccaactcaatggcatttgatgtaattttcatgatttagaagaattattcacccaatcccatttctatattctgacttctgattcactccgcagtggacctatatctggcttctgacctaaccatttcatcaaaattgttcttacgtaacccagtgtcaccaaggatcagcctccttttcagagctagattaaggttggcttgaatcactcaactccacatccttcagacataaaaggtcaatgcaagatgctcccattttcatagttcctctacctgtggacctttatattcttgtacactatatgtctctctcacaggcctagacatgaaactctgccattttactctaaagaaacaaaactccgcattaatgagtttattgaagattcaggttaacctgaatcaagttaacccagtctcaaatgctcacttatcctatctccttggcacaaatctctcctctcctggattgccaaagaaaattcaaattattcttcaattagtcaggatgatttgactatcagcagttcatagtacccatcttcataactaagccacctagggatccagcagaaaaaaaagggatgaggggagtcatcatacaggaggtggatcatttaccaggatccacacttcctacaaagcggttgtaatattaaataacaaaactgttttttattccaatcttcacataaaacaggaataattgtatactttcttactaatgtgttccatggagtttttcctccaagaagtggcttaggggaaaatgagccccagtaatgctttgtggcatccaatccttctaccccgaccctttgactttctgccccagcccctcttagttctcctagaattaggactaaggttaagtgccctcttgggatatgacttccttcccttcctcttgatacaaaaagagcctattaccaaccctcatacacacaagagttcccttcctagttgcagactcttctgctccagctggactcccctagctctggactcccactagatcacacaggggtccctgcatgtcagtaaactttggatgaccttgggagaccaaaaaatggaatatcattttttgatctaaacaaaatagtttcctgatttaacactggccaggaaggtgggctgcaccctcagtctctctctcccatcatggttttcacatgatatcaaaggactctcataacagtctgattcttatgagttgggcatcctgtgtttccctttaggggcctgcttccttcaaatagaggagatgggtgctatgaaacctattcactctggacttgggatggctcttctccatcttcccaagtctgagctggagcctccatgcccaactctgctctgctcttctatttcctgacagcagctaaggcatgttcctgttctgcccccaaattgaccttactaacagtgagaacttggaggagtcttcgggtcttgggaaatccaagttttcccggaaacgttttgttgtaaacagtgtccacactctttgctccaataaagctcggttccttaagccactttgaatgtc

SEQ ID NO: 419358 - DNA, 2706 bp, Homo sapiens
tcgcctgtgtacctttgtactttctacagtgaaagttgctacaggatctccctttctcaataaattcatctgcggtggagaaaatcagcatgagtactacaggccaagtcatcagatgcaaagcagccatactctggaagcctggtgcaccattttctattgaagaggtagaagtggccccaccaaaggcaaaggaagttcgcataaaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccaggtgacaaagttatcacactctttctgccacagtgtggagaatgtacctcttgcctgaattctgagggcaatttttgtatacaattcaaacagtcaaaaacccaactgatgtctgatggtaccagcaggtttacctgcaagggaaaagaaatctcagttgccaagattgatgcagtcgctcctctagagaaagtatgcctaattagctgtggcttttccactgggtttggtgctgcaatcaatactgccaaggtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggcagctgccctcgcctcctgcaatgagagctatggggtctgtgtggttgttggggtgttgcctgccagtgttcaactcaaaatcagtggccagttgttcttctcaggacgttctttgaagggttctgtttttggaggctggaagagcagacagcacatccctaaactggttgctgattatatggcagagaagttgaatctagatccactaattactcatactctgaatcttgataaaatcaatgaagcagttgaattaatgaaaactggaaaatgccaaaggatatttcaccaactcaatggcatttgatgtaattttcatgatttagaagaattattcacccaatcccatttctatattctgacttctgattcactccgcagtggacctatatctggcttctgacctaaccatttcatcaaaattgttcttacgtaacccagtgtcaccaaggatcagcctccttttcagagctagattaaggttggcttgaatcactcaactccacatccttcagacataaaaggtcaatgcaagatgctcccattttcatagttcctctacctgtggacctttatattcttgtacactatatgtctctctcacaggcctagacatgaaactctgccattttactctaaagaaacaaaactccgcattaatgagtttattgaagattcaggttaacctgaatcaagttaacccagtctcaaatgctcacttatcctatctccttggcacaaatctctcctctcctggattgccaaagaaaattcaaattattcttcaattagtcaggatgatttgactatcagcagttcatagtacccatcttcataactaagccacctagggatccagcagaaaaaaaagggatgaggggagtcatcatacaggaggtggatcatttaccaggatccacacttcctacaaagcggttgtaatattaaataacaaaactgttttttattccaatcttcacataaaacaggaataattgtatactttcttactaatgtgttccatggagtttttcctccaagaagtggcttaggggaaaatgagccccagtaatgctttgtggcatccaatccttctaccccgaccctttgactttctgccccagcccctcttagttctcctagaattaggactaaggttaagtgccctcttgggatatgacttccttcccttcctcttgatacaaaaagagcctattaccaaccctcatacacacaagagttcccttcctagttgcagactcttctgctccagctggactcccctagctctggactcccactagatcacacaggggtccctgcatgtcagtaaactttggatgaccttgggagaccaaaaaatggaatatcattttttgatctaaacaaaatagtttcctgatttaacactggccaggaaggtgggctgcaccctcagtctctctctcccatcatggttttcacatgatatcaaaggactctcataacagtctgattcttatgagttgggcatcctgtgtttccctttaggggcctgcttccttcaaatagaggagatgggtgctatgaaacctattcactctggacttgggatggctcttctccatcttcccaagtctgagctggagcctccatgcccaactctgctctgctcttctatttcctgacagcagctaaggcatgttcctgttctgcccccaaattgaccttactaacagtgagaacttggaggagtcttcgggtcttgggaaatccaagttttcccggaaacgttttgttgtaaacagtgtccacactctttgctccaataaagctcggttccttaagccactttgaatgtc

SEQ ID NO: 419359 - DNA, 2154 bp, Homo sapiens
tcgcctgtgtacctttgtactttctacagtgaaagttgctacaggatctccctttctcaataaattcatctgcggtggagaaaatcagcatgagtactacaggccaagtcatcagatgcaaagcagccatactctggaagcctggtgcaccattttctattgaagaggtagaagtggccccaccaaaggcaaaggaagttcgcataaaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccaggtgacaaagttatcacactctttctgccacagtgtggagaatgtacctcttgcctgaattctgagggcaatttttgtatacaattcaaacagtcaaaaacccaactgatgtctgatggtaccagcaggtttacctgcaagggaaaagaaatctcagttgccaagattgatgcagtcgctcctctagagaaagtatgcctaattagctgtggcttttccactgggtttggtgctgcaatcaatactgccaaggtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggcagctgccctcgcctcctgcaatgagagctatggggtctgtgtggttgttggggtgttgcctgccagtgttcaactcaaaatcagtggccagttgttcttctcaggacgttctttgaagggttctgtttttggaggctggaagagcagacagcacatccctaaactggttgctgattatatggcagagaagttgaatctagatccactaattactcatactctgaatcttgataaaatcaatgaagcagttgaattaatgaaaactggaaaatgtatccgctgtatcctgttactttaagtacaatgtaatacatgcaagacccaaaggatatttcaccaactcaatggcatttgatgtaattttcatgatttagaagaattattcacccaatcccatttctatattctgacttctgattcactccgcagtggacctatatctggcttctgacctaaccatttcatcaaaattgttcttacgtaacccagtgtcaccaaggatcagcctccttttcagagctagattaaggttggcttgaatcactcaactccacatccttcagacataaaaggtcaatgcaagatgctcccattttcatagttcctctacctgtggacctttatattcttgtacactatatgtctctctcacaggcctagacatgaaactctgccattttactctaaagaaacaaaactccgcattaatgagtttattgaagattcaggttaacctgaatcaagttaacccagtctcaaatgctcacttatcctatctccttggcacaaatctctcctctcctggattgccaaagaaaattcaaattattcttcaattagtcaggatgatttgactatcagcagttcatagtacccatcttcataactaagccacctagggatccagcagaaaaaaaagggatgaggggagtcatcatacaggaggtggatcatttaccaggatccacacttcctacaaagcggttgtaatattaaataacaaaactgttttttattccaatcttcactctggacttgggatggctcttctccatcttcccaagtctgagctggagcctccatgcccaactctgctctgctcttctatttcctgacagcagctaaggcatgttcctgttctgcccccaaattgaccttactaacagtgagaacttggaggagtcttcgggtcttgggaaatccaagttttcccggaaacgttttgttgtaaacagtgtccacactctttgctccaataaagctcggttccttaagccactttgaatgtc

SEQ ID NO: 419360 - DNA, 1432 bp, Homo sapiens
ggaaaagctcgataattacccagcctaaccatttctcaggtgcttgcgaggtgatcagaaggcaaagatgtcggagcgaaaagtattaaacaaatactacccgccggactttgacccatcaaagatccccaaactcaagctccccaaagaccggcagtacgtggtgcggctgatggcccccttcaacatgaggtgtaagacgtgcggagaatacatctacaaggggaagaaattcaatgctcggaaggagacggtgcagaacgaggtctacctgggcctgcccatcttccgcttttacatcaagtgcacgcgctgcctggcagagatcaccttcaagacagaccctgaaaacacagactacaccatggagcatggagccacgcggaatttccaggctgagaagctcctggaggaggaggagaagagggtgcagaaggagcgggaggacgaggagctgaacaaccccatgaaggtgctggagaaccggaccaaggactccaagctggagatggaggtgctggagaacctccaggagctgaaagacctgaaccagcggcaggcgcacgtggacttcgaggctatgctgaggcagcaccgcctgtcggaggaggagcggcggaggcagcagcaggaggaggacgagcaggagaccgcggccctgttggaggaagccagaaagcgaagactgctggaggactccgactcagaggatgaggctgctccctcgcccctgcagccagcccttcggcccaaccccaccgccatcctggatgaggccccaaagcccaagaggaaggtggaggtctgggagcagagcgttggcagcctgggcagccggcccccgctgtcgaggctggtcgtggtgaagaaggcaaaggccgacccggactgcagcaacgggcagcctcaggcggcccccaccccaggagccccgcagaacaggaaggaggccaaccctacacccctgacgcctggcgcgtcctccctgagccaactgggtgcatacctggacagtgacgacagcaacggcagcaactgagccctcccaggaccccctcacggggtcaaagtcacacgtccagcttcagccacattgaggccagcattgctggtggtcagggcaggaggccttggcgtgactggaggccggacagacaagcgccagcgtgctccaacacatagggccaccaggggcctcagccccaggaggtcccttctctgtgccctcaccagcctctcaacacctcggggacccctgctgctcctgcccccacctgtcactgtgcttagggctgcaacatccctggagcagcttccaacactacttcagggtggcagtgtttggggcactgggcgagcctgccggcctctagatggcctcatctcttccttccacaaactgtctagaaccaataaaaggaaacctgccaac

SEQ ID NO: 419361 - DNA, 1436 bp, Homo sapiens
catagctagtagaggccgtgttaatcggcgaggcatttctcaggtgcttgcgaggtgatcagaaggcaaagatgtcggagcgaaaagtattaaacaaatactacccgccggactttgacccatcaaagatccccaaactcaagctccccaaagaccggcagtacgtggtgcggctgatggcccccttcaacatgaggtgtaagacgtgcggagaatacatctacaaggggaagaaattcaatgctcggaaggagacggtgcagaacgaggtctacctgggcctgcccatcttccgcttttacatcaagtgcacgcgctgcctggcagagatcaccttcaagacagaccctgaaaacacagactacaccatggagcatggagccacgcggaatttccaggctgagaagctcctggaggaggaggagaagagggtgcagaaggagcgggaggacgaggagctgaacaaccccatgaaggtgctggagaaccggaccaaggactccaagctggagatggaggtgctggagaacctccaggagctgaaagacctgaaccagcggcaggcgcacgtggacttcgaggctatgctgaggcagcaccgcctgtcggaggaggagcggcggaggcagcagcaggaggaggacgagcaggagaccgcggccctgttggaggaagccagaaagcgaagactgctggaggactccgactcagaggatgaggctgctccctcgcccctgcagccagcccttcggcccaaccccaccgccatcctggatgaggccccaaagcccaagaggaaggtggaggtctgggagcagagcgttggcagcctgggcagccggcccccgctgtcgaggctggtcgtggtgaagaaggcaaaggccgacccggactgcagcaacgggcagcctcaggcggcccccaccccaggagccccgcagaacaggaaggaggccaaccctacacccctgacgcctggcgcgtcctccctgagccaactgggtgcatacctggacagtgacgacagcaacggcagcaactgagccctcccaggaccccctcacggggtcaaagtcacacgtccagcttcagccacattgaggccagcattgctggtggtcagggcaggaggccttggcgtgactggaggccggacagacaagcgccagcgtgctccaacacatagggccaccaggggcctcagccccaggaggtcccttctctgtgccctcaccagcctctcaacacctcggggacccctgctgctcctgcccccacctgtcactgtgcttagggctgcaacatccctggagcagcttccaacactacttcagggtggcagtgtttggggcactgggcgagcctgccggcctctagatggcctcatctcttccttccacaaactgtctagaaccaataaaaggaaacctgccaac

SEQ ID NO: 419362 - DNA, 1579 bp, Homo sapiens
ccgccaccatgcctggttaattttttttgtattttagtagagatgagatttcaccatgttgcccagggtggttttgaactcttgatctcaggcattccacccacctcatactcccaaagtgctggaattacaggcgtgagccaccgcgcccggccccacgcaggtctttctaggagagcagtctcaggcttgctgtaggaactcctgggaaacaggagccctgggatacaaagggagtaaatactacccgccggactttgacccatcaaagatccccaaactcaagctccccaaagaccggcagtacgtggtgcggctgatggcccccttcaacatgaggtgtaagacgtgcggagaatacatctacaaggggaagaaattcaatgctcggaaggagacggtgcagaacgaggtctacctgggcctgcccatcttccgcttttacatcaagtgcacgcgctgcctggcagagatcaccttcaagacagaccctgaaaacacagactacaccatggagcatggagccacgcggaatttccaggctgagaagctcctggaggaggaggagaagagggtgcagaaggagcgggaggacgaggagctgaacaaccccatgaaggtgctggagaaccggaccaaggactccaagctggagatggaggtgctggagaacctccaggagctgaaagacctgaaccagcggcaggcgcacgtggacttcgaggctatgctgaggcagcaccgcctgtcggaggaggagcggcggaggcagcagcaggaggaggacgagcaggagaccgcggccctgttggaggaagccagaaagcgaagactgctggaggactccgactcagaggatgaggctgctccctcgcccctgcagccagcccttcggcccaaccccaccgccatcctggatgaggccccaaagcccaagaggaaggtggaggtctgggagcagagcgttggcagcctgggcagccggcccccgctgtcgaggctggtcgtggtgaagaaggcaaaggccgacccggactgcagcaacgggcagcctcaggcggcccccaccccaggagccccgcagaacaggaaggaggccaaccctacacccctgacgcctggcgcgtcctccctgagccaactgggtgcatacctggacagtgacgacagcaacggcagcaactgagccctcccaggaccccctcacggggtcaaagtcacacgtccagcttcagccacattgaggccagcattgctggtggtcagggcaggaggccttggcgtgactggaggccggacagacaagcgccagcgtgctccaacacatagggccaccaggggcctcagccccaggaggtcccttctctgtgccctcaccagcctctcaacacctcggggacccctgctgctcctgcccccacctgtcactgtgcttagggctgcaacatccctggagcagcttccaacactacttcagggtggcagtgtttggggcactgggcgagcctgccggcctctagatggcctcatctcttccttccacaaactgtctagaaccaataaaaggaaacctgccaac

SEQ ID NO: 419363 - DNA, 1309 bp, Homo sapiens
ggaaaagctcgataattacccagcctaaccatttctcaggtgcttgcgaggtgatcagaaggcaaagatgtcggagcgaaaagtattaaacaaatactacccgccggactttgacccatcaaagatccccaaactcaagctccccaaagaccggcagtacgtggtgcggctgatggcccccttcaacatgaggtgtaagacgtgcggagaatacatctacaaggggaagaaattcaatgctcggaaggagacggtgcagaacgaggtctacctgggcctgcccatcttccgcttttacatcaagtgcacgcgctgcctggcagagatcaccttcaagacagaccctgaaaacacagactacaccatggagcatggagccacgcggaatttccaggctgagaagctcctggaggaggaggagaagagggtgcagaaggagcgggaggacgaggagctgaacaaccccatgaaggtgctggagaaccggaccaaggactccaagctggagatggaggtgctggagaacctccaggagctgaaagacctgaaccagcggcaggcgcacgtggacttcgaggctatgctgaggcagcaccgcctgtcggaggaggagcggcggaggcagcagcaggaggaggacgagcaggagaccgcggccctgttggaggaagccagaaagcgaagactgctggaggactccgactcagaggatgaggctgctccctcgcccctgcagccagcccttcggcccaaccccaccgccatcctggatgaggccccaaagcccaagaggaaggtggaggtctgggagcagagcgttggcagcctgggcagccggcccccgctgtcgaggctggtcgtggtgaagaaggcaaaggcatacctggacagtgacgacagcaacggcagcaactgagccctcccaggaccccctcacggggtcaaagtcacacgtccagcttcagccacattgaggccagcattgctggtggtcagggcaggaggccttggcgtgactggaggccggacagacaagcgccagcgtgctccaacacatagggccaccaggggcctcagccccaggaggtcccttctctgtgccctcaccagcctctcaacacctcggggacccctgctgctcctgcccccacctgtcactgtgcttagggctgcaacatccctggagcagcttccaacactacttcagggtggcagtgtttggggcactgggcgagcctgccggcctctagatggcctcatctcttccttccacaaactgtctagaaccaataaaaggaaacctgccaac

SEQ ID NO: 419364 - DNA, 1875 bp, Homo sapiens
ggtgggcgggagcgcccttccaggagatgggttggctgcagtagtgagaggctgggggtgcggctctttccctgcagtcctgccgaggaagcgtgcgtccctggcgcttccttcttctcttccggcggagagcttgggatgtggtaatgccagccacactcctcagagccgtggccagatctcatcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccattaaatgctgctcgttgccaagatgaaaaggcacaccttccaaccatgaaatcctttggtactcacaggagagtgacccacaaaccaaatctgttgggttctaaatggtttataaaaatattaaagaggcatttctcatctgtatcaacggaaacatttgttccaaaacaagacttcccacaggtgaagagaccactaaaagcatccaggaccagacagccatccaggaccaaccttccagttctgtctgtgaacgaggacctaatgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctgatcaagtgataaccaaagtgtcactgcaagagatattcaagttctacaatcaaaaattaaatgttcggcccggcgcggtgcctcatgcctgtaatcccagcactttcggaggccaagaagggtggcttgagatgagatcaggagctcaagacaagcctggccaacatggtgaaaccccatctctactaaaaataccaaaattagccaggtgtgttggcacacgcccgtcatctcagctactcaggaggctgaggcaggagaatctcttgaacttgggaggcggaggttgcagtgagctaagatcacaccactgcactccagccagggcaacagtgagactcagtctcaaaaataaacaataaaataaataaataaatgtt

SEQ ID NO: 419365 - DNA, 968 bp, Homo sapiens
ggtgggcgggagcgcccttccaggagatgggttggctgcagtagtgagaggctgggggtgcggctctttccctgcagtcctgccgaggaagcgtgcgtccctggcgcttccttcttctcttccggcggagagcttgggatgtggtaatgccagccacactcctcagagccgtggccagatctcatcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccattaaatgctgctcgttgccaagatgaaaaggcacaccttccaaccatgaaatcctttggtactcacaggagagtgacccacaaaccaaatctgttgggttctaaatggtttataaaaatattaaagaggcatttctcatctgtatcaacggaaacatttgttccaaaacaagacttcccacaggtgaagagaccactaaaagcatccaggaccagacagccatccaggaccaaccttccagttctgtctgtgaacgaggacctaatgcactgcacagcatttgcaacggcagatgagtatcatctgggaaatctgtctcaagatctggcctcccacggatatgttgaagtaacaagcttgcctagaggtacttcttcttgaacctggggccaagtatgttaaaatgtattggataattttcctatgatactatcttaagtatgtatttgtttgcaattcattttcttttgaaaggattgtatcataaaagtggatgttgaatctctttataaagatgacaaagttaagaattaaaatgtatttacagagaactcattaaaatcagtatgatttatt

SEQ ID NO: 419366 - DNA, 1968 bp, Homo sapiens
ggtgggcgggagcgcccttccaggagatgggttggctgcagtagtgagaggctgggggtgcggctctttccctgcagtcctgccgaggaagcgtgcgtccctggcgcttccttcttctcttccggcggagagcttgggatgtggtaatgccagccacactcctcagagccgtggccagatctcatcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccattaaatgctgctcgttgccaagatgaaaaggcacaccttccaaccatgaaatcctttggtactcacaggagagtgacccacaaaccaaatctgttgggttctaaatggtttataaaaatattaaagaggcatttctcatctgtatcaacggaaacatttgttccaaaacaagacttcccacaggtgaagagaccactaaaagcatccaggaccagacagccatccaggaccaaccttccagttctgtctgtgaacgaggacctaatgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctgatcaagtgataaccaaagtgtcactgcaagagatattcaagttctacaatcaaaaattaaatgttcggcccggcgcggtgcctcatgcctgtaatcccagcactttcggaggccaagaagggtggcttgagatgagatcaggagctcaagacaagcctggccaacatggtgaaaccccatctctactaaaaataccaaaattagccaggtgtgttggcacacgcccgtcatctcagctactcaggaggctgaggcaggagaatctcttgaacttgggaggcggaggttgcagtgagctaagatcacaccactgcactccagccagggcaacagtgagactcagtctcaaaaataaacaataaaataaataaataaatgttcactactgggtgatcatttaataggtgtttttttaatcaagaaattatctttttcagcccagtatatcgtgtgaataaaattatgaagaatct

SEQ ID NO: 419367 - DNA, 1503 bp, Homo sapiens
ggtgggcgggagcgcccttccaggagatgggttggctgcagtagtgagaggctgggggtgcggctctttccctgcagtcctgccgaggaagcgtgcgtccctggcgcttccttcttctcttccggcggagagcttgggatgtggtaatgccagccacactcctcagagccgtggccagatctcatcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccattaaatgctgctcgttgccaagatgaaaaggcacaccttccaaccatgaaatcctttggtactcacaggagagtgacccacaaaccaaatctgttgggttctaaatggtttataaaaatattaaagaggcatttctcatctgtatcaacggaaacatttgttccaaaacaagacttcccacaggtgaagagaccactaaaagcatccaggaccagacagccatccaggaccaaccttccagttctgtctgtgaacgaggacctaatgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggtacgtattttgcacttctaatgagagaaaaagacacgttgtcgcctataagttgaatatgtttaactgcttgcagagaaatatcttgtttgacttccattcaaatctctttatatttccccttcttgtcctctgtacagtcacttcaattttttgt

SEQ ID NO: 419368 - DNA, 1151 bp, Homo sapiens
aacgatggtcctcagctcaggacgagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctgatcaagtgataaccaaagtgtcactgcaagagatattcaagttctacaatcaaaaattaaatgttcggcccggcgcggtgcctcatgcctgtaatcccagcactttcggaggccaagaagggtggcttgagatgagatcaggagctcaagacaagcctggccaacatggtgaaaccccatctctactaaaaataccaaaattagccaggtgtgttggcacacgcccgtcatctcagctactcaggaggctgaggcaggagaatctcttgaacttgggaggcggaggttgcagtgagctaagatcacaccactgcactccagccagggcaacagtgagactcagtctcaaaaataaacaataaaataaataaataaatgttcactactgggtgatcatttaataggtgtttttttaatcaagaaattatctttttcagcccagtatatcgtgtgaataaaattatgaagaatct

SEQ ID NO: 419369 - DNA, 1085 bp, Homo sapiens
agcaagaccctctctcttaccaaaaaaaaaaaagttttcataaagcactatgtaaatattaaatacaatagaaacaatgatttttaattcaagataaataaaaagttataattttcctttttaaaggcaccgtataaacttgagttcagacttcctgattactcctgatttctactgggacagagaaaacctggaaggactttacgataaaacgtgtcaattccttagcattggccgaagagttaaggtacgtattttgcacttctaatgagagaaaaagacacgttgtcgcctataagttgaatatgtttaactgcttgcagagaaatatcttgtttgacttccattcaaatctctttatatttccccttcttgtcctctgtacagtcacttcaattttttgtgtcaaaggatcttctgatattagctctacagactagataaggttggtgaataagatgagagtttggaagcctaatggtccatcagtaagttcttgtcaagtttcaagcaagagttcatgactgcttctgatctgtcatggtgacagtgagaatagaaataaatttaagaaagaatcatgtaagacaaatcaagtgatgggtaataagaggccatggagaagaaagaataaaggatgactgatgtttgcctggaggtgacaagtagaaaggtggaaaaacaataatgagaggtcagagaggggaggtgacagactaaatctaagatatgctgagattagagtagcaacaagatatccaattagctccgtcatgcaggcatttagaagggcagaagcaaagtcgggaaaagagacgtgtattaagaaatcccagcactttgggaggctgaggcggatggatcacctgaggttgggagtttgagaccagcctggccaacatggcgaaaccctgtctctactaaaaatacaaaaattagccaggcatggtggcattctcctatagtccgagctactcgagaggctgaggcaggagaatcacttgaacccaggaggtggaggttgcagtgagccaaggtcgagccagtgcactccagcctggatgacagagtgagactccgtctca

SEQ ID NO: 419370 - DNA, 366 bp, Homo sapiens
caaattagtaagtaccatcatattttgaaaaatcgcatcctgtatacattctagaagttacatggttttatatacgaccctaaagaatgtattccatctgtatcttagttgtttcttttatttttttaaatcagggaaggagctgctgtgttttggaatgtgaaagacaaaactgtaagtgtaaataaaaatgtgaaaatataaaaatttagttttgtgagaatgaattgttaattagcacatactgaaacattagaagggaaattaatagattatgcacaacttatttgctctgcattacatgatacttatcagtttcatcttccaaaatatattgtattttgggttaagatttcctgctttttc

SEQ ID NO: 419371 - DNA, 1411 bp, Homo sapiens
atcaactttaaagatattttaaacttgatgaagacttctgaatctatcagaaaacaggttagaatgtctgtcttcaagtcttgattctgaaaagtagcccctgagcctgtttcattttggctgtgtttttattactgtgcagctgacaccccttggaaaggacctaatgcactgcacagcatttgcaacggcagatgagtatcatctgggaaatctgtctcaagatctggcctcccacggatatgttgaagtaacaagcttgcctagaggtacttcttcttgaacctggggccaaatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctgatcaagtgataaccaaagtgtcactgcaagagatattcaagttctacaatcaaaaattaaatgttcggcccggcgcggtgcctcatgcctgtaatcccagcactttcggaggccaagaagggtggcttgagatgagatcaggagctcaagacaagcctggccaacatggtgaaaccccatctctactaaaaataccaaaattagccaggtgtgttggcacacgcccgtcatctcagctactcaggaggctgaggcaggagaatctcttgaacttgggaggcggaggttgcagtgagctaagatcacaccactgcactccagccagggcaacagtgagactcagtctcaaaaataaacaataaaataaataaataaatgtt

SEQ ID NO: 419372 - DNA, 1912 bp, Homo sapiens
ggtgggcgggagcgcccttccaggagatgggttggctgcagtagtgagaggctgggggtgcggctctttccctgcagtcctgccgaggaagcgtgcgtccctggcgcttccttcttctcttccggcggagagcttgggatgtggtaatgccagccacactcctcagagccgtggccagatctcatcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccattaaatgctgctcgttgccaagatgaaaaggcacaccttccaaccatgaaatcctttggtactcacaggagagtgacccacaaaccaaatctgttgggttctaaatggtttataaaaatattaaagaggcatttctcatctgtatcaacggaaacatttgttccaaaacaagacttcccacaggtgaagagaccactaaaagcatccaggaccagacagccatccaggaccaaccttccagttctgtctgtgaacgaggacctaatgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagaatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctgatcaagtgataaccaaagtgtcactgcaagagatattcaagttctacaatcaaaaattaaatgttcggcccggcgcggtgcctcatgcctgtaatcccagcactttcggaggccaagaagggtggcttgagatgagatcaggagctcaagacaagcctggccaacatggtgaaaccccatctctactaaaaataccaaaattagccaggtgtgttggcacacgcccgtcatctcagctactcaggaggctgaggcaggagaatctcttgaacttgggaggcggaggttgcagtgagctaagatcacaccactgcactccagccagggcaacagtgagactcagtctcaaaaataaacaataaaataaataaataaatgttcactactgggtgatcatttaataggtgtttttttaatcaagaaattatctttttcagcccagtatatcgtgtgaataaaattatgaagaatct

SEQ ID NO: 419373 - DNA, 1450 bp, Homo sapiens
ggtgggcgggagcgcccttccaggagatgggttggctgcagtagtgagaggctgggggtgcggctctttccctgcagtcctgccgaggaagcgtgcgtccctggcgcttccttcttctcttccggcggagaggacctaatgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctgatcaagtgataaccaaagtgtcactgcaagagatattcaagttctacaatcaaaaattaaatgttcggcccggcgcggtgcctcatgcctgtaatcccagcactttcggaggccaagaagggtggcttgagatgagatcaggagctcaagacaagcctggccaacatggtgaaaccccatctctactaaaaataccaaaattagccaggtgtgttggcacacgcccgtcatctcagctactcaggaggctgaggcaggagaatctcttgaacttgggaggcggaggttgcagtgagctaagatcacaccactgcactccagccagggcaacagtgagactcagtctcaaaaataaacaataaaataaataaataaatgttcactactgggtgatcatttaataggtgtttttttaatcaagaaattatctttttcagcccagtatatcgtgtgaataaaattatgaagaatct

SEQ ID NO: 419374 - DNA, 674 bp, Homo sapiens
gcggagggcgactagaggagcggatatggaagcgagcgaaagccggaagcaggcaagggaccgggaggtcccagggcctagggagcggaagaggtcgcggcgacgcggctcacgtggtcagacagtcacgtggcccgagtttctcccgctaagtgggaccagagttcagtgcggctgcgcagtagcgggggtgggcgggagcgcccttccaggagatgggttggctgcagtagtgagaggctgggggtgcggctctttccctgcagtcctgccgaggaagcgtgcgtccctggcgcttccttcttctcttccggcggagaggttagtgtattgccttttctttagcagctcgagtggtccggcttggaggtctgcgccctggctcctggccgcccggaacgtgtacagttacgggttacgccagtgcggctgtgaccctttgcctcttaccgtgatctttggtcagcttagctgggagtaaaaagcactcaattaatgaaccctttttttgagccagtgcaccgcggtaactgtagaaatcgataaaataattttgagtttgaggaattgaacggcatactcccaaagatgagcgccacttagctctcgaatcgtagcctagctgtaatcgattttcttaattggtgtaattgttctctaaaagttgaaatgtg

SEQ ID NO: 419375 - DNA, 6331 bp, Homo sapiens
cgaacaattaattaaaaaggaggttaattcacagtttacagacttagcatctgcttgtttagcatatgcaataaaaggcgaagttgtggtagatttgcaaaaatgtcagttagataattgattatatatataggaatcattttttgcataatccaaatcctctttttcttttgatgatcctaagatatcattttagaacggaatgtggtatttgtaccctatgtattttatgacttaattattctaagttgaaagaatttatatatttttttgtataccacattcgtcactggatttctggaacttttttaaaaaatcggtgaattgggccgttggtggcggctgtgatgaaggaccctgcaggcatctggctgtaattggcgcctgcggcggccagggcccctacgggtgcggcgctgaaggccgccccgtaccccggaggtgtagcgtagggacccggcgggtaggccggtgtggggtgaggctccgtgcccttgctggccagccggctgaggatgctgcgctcggacatctgaaggcgggctgcgatggggggtattcgggacagcgtggctggcaggcgggtcacgtccgccttcatgtcgctcagcaactcctccagctggttcagaaccttgtgcaggacggcgttggccggcttgttccccgccagcgactccttggagaggtgctggtggctctcggccaggcactcggcctcggcgaagcgggcgtggagggccatggcggggtgcgccggctcctgcgacaggttcaggtaggccgcccgccgcagctgctcctcaatcaccagcgcctgctccaggagcttgaacctccgggccaggaacttatttttcatctccagaaagttccccttattggcttcagttttaaatggctcgttgataatggcaaattgagcatcattctggatgtcctgccaccgtgcatagccatggaggacaatcccagccagaagccaatagtcatgtcttctgtgccagatctcattgagtttccccgaggaaatagctgcccgttcctcattctgccacagtgtgtgaagctctgtgaagccaccatcggcgatattgaacatgaaccggggcttctctgtcttttcctctcgtcgcccattggaccgtggctcatctcgaggccctggtcgaagctcccggtcaccttttacatcttctgacttctctctgtccccacggtacccaggttcaggctccatctctccaggcacccctggcacctcatcctctagaggaatcttccttggctccagccgctccccaagtgatggggctgggctgggggcatcagcctctgtctccatcttctccccaattctgctgttcttctctggcttttcctcctggttttcagcttcctccttctcaagaggtgtccttatgccttctcctttctcacttggagctggagtagcaggtttagaggtgcagggactgttggtagcagaagcctcaggagtggtgggagacgttttggtaggagaggaggctctggaggagcgcttagaatcggcgctggggtcaggcatcagttccggcattgaccaacgcccattgatgtgctcaaactcctgcaccttctttttgacgagagacatgactccaatgcgggtcaacacctgctggcgactcagtccctcccgagggaccccatcggcaaaggtttcagagccgtctgccccaggctcacacagatggcgcatgaacaaagacacataggccttaaactccttctcagtcttgcccctcaggtcccgcaccagccactgtgtggtgaaggcatcctgtggtggcatcccccagcgcatcacagcattgaggaaagccttccgctgacgggtgttgaagcccagcacctcaatgttgcccccgactcgggccagcagtggaggcagtggcttatctttctcattccggagctgcctctttgactgtctacgcccttcaggacgttcatcgaagtcttcatcctcctcctctgaacccaccgagtactctgactggttgtcttggtcttcctgagcagcatcattgtagttaacttgcttgcgaacccgcttgcccttgcctagattccgggctaggtcttcctgctgttgctcatagtgatgcctcagcagcttctcccagtagtcagggtccacattctcctcctgcttgatgatctctcgctcaatttcctcaatcttgtcttcttcccgcacgacgtactgtgccaccttgaaggagctgagatactcattcatgttctgcacgtcagtgtcctcagttgcatcctggttccggtccaacagccgagcgatggcctcattgtcataatgaatcacactgctgtcctcctccttgttctccccctcgttttcatccttgaatagctcttcagtgccaaatttgagaatgtcgtcaagctcctgcttggacatggagcctgccttggagcccagcccaggccgcacaaccaggtgtgtcagcatcatctttctcttggccacttgtgtgattcgctcttccactgacgcgcgagtcacaaaccggtaaatcatcactttgttggcctggccaatccgatgagcccggctaaaggcctggatgtcattatgggggttccagtcagaatcaaagatgatgacagtgtcagcagtggccagattgatgcccaggcccccagctcgggtggacaggaggaagcagaattgttgggccccaggagcattaaaccgatcgatggcctcctgcctcagggcacccgtgataccaccatcgatgcgctcatacttgtagccttcatagtctaagaagtcctcaagcaagtctaacattttggtcatctgcgagaagatgagcactcggtgtccttgctccttcagctttcgcagcatcttctggagcagcatgagcttcccagacgacttaataagtgccccaccctcataagccccactggggagtttgggggactccatagcagccacgggaaaaaggtatggatggttgcagcacttcttaagatccatcatgatattaagcagcgacacctggttcccaccacctcgtgaattcaaggcctcaaaatttcgagtcaggatgtatttgtagtatttcttctgcatggggcttagctccacccgaacgatgagctctgtcttggctggcatgttcttaaagacatctgccttgagtctccgcagcatgtgtggccccagcaaatcatgcagtttcttgatctggtcctctttggatatgtcagcaaactcctccaggaagccctccaagttgttaaatctctctggggtgaggaagttcaggagatggaagagctcctccagattattctgcaatggggttcctgtcagcagcaacttatgatctatcttgtaaccattgagaaccctgaaaaacttggactggttgttcttgagtcgatgggcctcatctaccacaagacaggcccagcggatggaaccaagtgctgcctgatcaatggtgatcagctcatacgatgtcaggagaacatggaacttcacctgtgcctcccttttcatcttaaaagctttcttgccccctttgatggcattgtcctcaaaggagaattcattctcacgaatgatggcccggctgtccttgtcacccgtgtatgtcaccacatagaatttgggtgcccacatctggaactcccgctcccagttaatgatggtagagagtggggcactcaccaggaagggaccttttgtgtggccctccttgtagagtgagtagaggaagacgatggtttgtatggtcttgcctagccccatctcatcagctagaatggtgtcagtgccctgggcccaggagaagcgtagccagttcagcccttccaactgatacatgtgcagggtgcctccagtggctgtgataaaccgtggctgagtctcatatttcacggtaggatcattagtgggagaactgggaggcccatcaccctgtagctccttcttcttcttcttatacttgcggggctgggcagggtcttcccccataattagttctcggtgtctccagtagctttgcttatgttcttcgtattcagggatattcatttcatcttcctcccacgtggactggtcatatggtaagtccctccattttactagatagtggtaattcccctttttatccacactgtggttgatgatgcggtggacggtcatccactctggcttgatgccaaaacgatagtacttctcctccatctcagcatagtgcgggtctttcactttacgcttgtcgctcttcccatcatcctcgccggagccatagtccaggggtgggggctcatccatgtcattcttccgctggtagtttcgatacataaccaaatggaagatttccagctgaagctccttggcccaggagcagtgccagtaggatagtcctacccacttgacaaagaactctcgctctgatctgccttgaagaggacgggggggtgggacatctggatttccatctgcctgttgaggggctggcactgctacaggtggctccccccaccgccaatgtaggatcttctgcactcgacccttcagcacggggcatgtgcatcggggacacagccattcaccattgggaatgtcaggcaggggagggtttagacaatgaatgtggtaggaggagatgcacgcgtcacagcacaggagctccccgccgtccttgcatacgcggcagtactccatgtgatcatcctcctcctccttctccccttcttcctctccctcctcttcgtattcttcttcttcctccttggcctcccactggaccccctccttctcacagtgagggcagctccatttgccctctggagcccggtcaagctcaggatcaaggcagacgaggtggtaggcacgagggcaggtgtcacacagaataatttccccaccctgctggcacacctcacagtaatcctggtgatccgtctcgtagccatcaacctcctcctccccggccactgcaggacagcccaggaccttcttcttcttccttcctggccggcctctctttagtttcttggtgcggacagggccatcaggccggcctgaggcactgtggacactgccactgtccaggtctgattcctcagcctctggttcaggaccttcgtcgctctgaaaaacatacgagcctcctttcttcctcttgccacccagaagccctagttttattttgagtggtgccattttctttccccgaagcttcttgcgtccatcaggcactcgggggctcttactccgcctcttatggcctggacctttgccctctttggttttggctcttcggatgggtgggggctggatatcagcagcagggggtggtggaagggcggggggtccggagggtgctatgggggtggccgacgagacagcagctgacacctgctcagctacagctgctgctgctgctgccgctgccgccgccacagcagctgctgaccccttgaaggggttgttggcactgaactctctccatttggccccaaggatggtcatcatcttagacattgggatcttaggattcttcttagcaattaggggcctcatgaactggctgaaggctttgtagttggtgagcgtgtggtaatcctcctcagagaacacatgctccacatcctccaggccccaggtcagaagcagagttgctgatgacttctgttccacttgcttttgccccccatctccctccccctttttccgccgctttgtcttcttctcctttttttctcggtgcttccttcttcgtttccgacccggtccggttccatattcactgcccccactctctgacttctcccggtactcatctcgctcagaaccaaattcctcctcactgtcacgcttcttgcgttttcggggttttcctggcttgttctccttctgcttcttgggtcctcgttttctcttcttcacacccaatgctgacggcagcagccgaatgtcatccttatcaggcatcctgtcaccccaacacagtcctggaggaaaagaaatcctcagctggtcatttttacttcttgcccacaggatcacagtgtctgccgccttcatcacacaggagaaagtctccacaattacctaaatattcctcctcccaagtagcctaaaacctaccttcaattctattcccatctccctgctccctttgggaactagggggccataccctttgtttcccgatctcacccttcacctccatattttgttccagatatcctgacccattcatctatacgcagtatgggagacccaaacaaagat

SEQ ID NO: 419376 - DNA, 6831 bp, Homo sapiens
aactgagccagtgaacggcacctttattctgaggctgaacagcagttgacttcctccctcataactgctccaccctccacgtggggagaggtaggggacggtaacatgcagccacccctcctcgtcccttcctccctcccagggctcattttcatccctctctaaagtccccctcctctcttcaaagctctcttccccacaaaagttcctaaaggccaggcaaggctgattctccacttccacatgagacagagctgattctgcagggaaacggctggggaggctccacctctttcctccccacaaccatttactgggaagttgtgtatacttggcagtgtgggaggaaggtacttggaagaccctgccagccatctcccacccagacttcttctcaccagcacagtcttcaaggcttggtgggaaaggtgtgtgggagtggagaaagacaaagggcccttcttgaagagaggagctgcagagaggggcaaaggggttcctagcccagtgatggcccaaggggtggggaaggtggagggctggcagcaggccccagcgcttgagctgggggtcggcctcggggacggggcctgggtgaagggcaggcctgggatccagtcagtcgtctatacagatcacctccccggctcggggctccttccgatccagcccgtctgacaccaatgcccccaccatttccttctccttcttcacaagcactggagggccgttggtggcggctgtgatgaaggaccctgcaggcatctggctgtaattggcgcctgcggcggccagggcccctacgggtgcggcgctgaaggccgccccgtaccccggaggtgtagcgtagggacccggcgggtaggccggtgtggggtgaggctccgtgcccttgctggccagccggctgaggatgctgcgctcggacatctgaaggcgggctgcgatggggggtattcgggacagcgtggctggcaggcgggtcacgtccgccttcatgtcgctcagcaactcctccagctggttcagaaccttgtgcaggacggcgttggccggcttgttccccgccagcgactccttggagaggtgctggtggctctcggccaggcactcggcctcggcgaagcgggcgtggagggccatggcggggtgcgccggctcctgcgacaggttcaggtaggccgcccgccgcagctgctcctcaatcaccagcgcctgctccaggagcttgaacctccgggccaggaacttatttttcatctccagaaagttccccttattggcttcagttttaaatggctcgttgataatggcaaattgagcatcattctggatgtcctgccaccgtgcatagccatggaggacaatcccagccagaagccaatagtcatgtcttctgtgccagatctcattgagtttccccgaggaaatagctgcccgttcctcattctgccacagtgtgtgaagctctgtgaagccaccatcggcgatattgaacatgaaccggggcttctctgtcttttcctctcgtcgcccattggaccgtggctcatctcgaggccctggtcgaagctcccggtcaccttttacatcttctctcttgcccaaatcccctgtttccccctccggcctctccctgtgttcctgtccatccaacggcttctcctcccccctttctcctggcgtcgactctgtggctgacttctctctgtccccacggtacccaggttcaggctccatctctccaggcacccctggcacctcatcctctagaggaatcttccttggctccagccgctccccaagtgatggggctgggctgggggcatcagcctctgtctccatcttctccccaattctgctgttcttctctggcttttcctcctggttttcagcttcctccttctcaagaggtgtccttatgccttctcctttctcacttggagctggagtagcaggtttagaggtgcagggactgttggtagcagaagcctcaggagtggtgggagacgttttggtaggagaggaggctctggaggagcgcttagaatcggcgctggggtcaggcatcagttccggcattgaccaacgcccattgatgtgctcaaactcctgcaccttctttttgacgagagacatgactccaatgcgggtcaacacctgctggcgactcagtccctcccgagggaccccatcggcaaaggtttcagagccgtctgccccaggctcacacagatggcgcatgaacaaagacacataggccttaaactccttctcagtcttgcccctcaggtcccgcaccagccactgtgtggtgaaggcatcctgtggtggcatcccccagcgcatcacagcattgaggaaagccttccgctgacgggtgttgaagcccagcacctcaatgttgcccccgactcgggccagcagtggaggcagtggcttatctttctcattccggagctgcctctttgactgtctacgcccttcaggacgttcatcgaagtcttcatcctcctcctctgaacccaccgagtactctgactggttgtcttggtcttcctgagcagcatcattgtagttaacttgcttgcgaacccgcttgcccttgcctagattccgggctaggtcttcctgctgttgctcatagtgatgcctcagcagcttctcccagtagtcagggtccacattctcctcctgcttgatgatctctcgctcaatttcctcaatcttgtcttcttcccgcacgacgtactgtgccaccttgaaggagctgagatactcattcatgttctgcacgtcagtgtcctcagttgcatcctggttccggtccaacagccgagcgatggcctcattgtcataatgaatcacactgctgtcctcctccttgttctccccctcgttttcatccttgaatagctcttcagtgccaaatttgagaatgtcgtcaagctcctgcttggacatggagcctgccttggagcccagcccaggccgcacaaccaggtgtgtcagcatcatctttctcttggccacttgtgtgattcgctcttccactgacgcgcgagtcacaaaccggtaaatcatcactttgttggcctggccaatccgatgagcccggctaaaggcctggatgtcattatgggggttccagtcagaatcaaagatgatgacagtgtcagcagtggccagattgatgcccaggcccccagctcgggtggacaggaggaagcagaattgttgggccccaggagcattaaaccgatcgatggcctcctgcctcagggcacccgtgataccaccatcgatgcgctcatacttgtagccttcatagtctaagaagtcctcaagcaagtctaacattttggtcatctgcgagaagatgagcactcggtgtccttgctccttcagctttcgcagcatcttctggagcagcatgagcttcccagacgacttaataagtgccccaccctcataagccccactggggagtttgggggactccatagcagccacgggaaaaaggtatggatggttgcagcacttcttaagatccatcatgatattaagcagcgacacctggttcccaccacctcgtgaattcaaggcctcaaaatttcgagtcaggatgtatttgtagtatttcttctgcatggggcttagctccacccgaacgatgagctctgtcttggctggcatgttcttaaagacatctgccttgagtctccgcagcatgtgtggccccagcaaatcatgcagtttcttgatctggtcctctttggatatgtcagcaaactcctccaggaagccctccaagttgttaaatctctctggggtgaggaagttcaggagatggaagagctcctccagattattctgcaatggggttcctgtcagcagcaacttatgatctatcttgtaaccattgagaaccctgaaaaacttggactggttgttcttgagtcgatgggcctcatctaccacaagacaggcccagcggatggaaccaagtgctgcctgatcaatggtgatcagctcatacgatgtcaggagaacatggaacttcacctgtgcctcccttttcatcttaaaagctttcttgccccctttgatggcattgtcctcaaaggagaattcattctcacgaatgatggcccggctgtccttgtcacccgtgtatgtcaccacatagaatttgggtgcccacatctggaactcccgctcccagttaatgatggtagagagtggggcactcaccaggaagggaccttttgtgtggccctccttgtagagtgagtagaggaagacgatggtttgtatggtcttgcctagccccatctcatcagctagaatggtgtcagtgccctgggcccaggagaagcgtagccagttcagcccttccaactgatacatgtgcagggtgcctccagtggctgtgataaaccgtggctgagtctcatatttcacggtaggatcattagtgggagaactgggaggcccatcaccctgtagctccttcttcttcttcttatacttgcggggctgggcagggtcttcccccataattagttctcggtgtctccagtagctttgcttatgttcttcgtattcagggatattcatttcatcttcctcccacgtggactggtcatatggtaagtccctccattttactagatagtggtaattcccctttttatccacactgtggttgatgatgcggtggacggtcatccactctggcttgatgccaaaacgatagtacttctcctccatctcagcatagtgcgggtctttcactttacgcttgtcgctcttcccatcatcctcgccggagccatagtccaggggtgggggctcatccatgtcattcttccgctggtagtttcgatacataaccaaatggaagatttccagctgaagctccttggcccaggagcagtgccagtaggatagtcctacccacttgacaaagaactctcgctctgatctgccttgaagaggacgggggggtgggacatctggatttccatctgcctgttgaggggctggcactgctacaggtggctccccccaccgccaatgtaggatcttctgcactcgacccttcagcacggggcatgtgcatcggggacacagccattcaccattgggaatgtcaggcaggggagggtttagacaatgaatgtggtaggaggagatgcacgcgtcacagcacaggagctccccgccgtccttgcatacgcggcagtactccatgtgatcatcctcctcctccttctccccttcttcctctccctcctcttcgtattcttcttcttcctccttggcctcccactggaccccctccttctcacagtgagggcagctccatttgccctctggagcccggtcaagctcaggatcaaggcagacgaggtggtaggcacgagggcaggtgtcacacagaataatttccccaccctgctggcacacctcacagtaatcctggtgatccgtctcgtagccatcaacctcctcctccccggccactgcaggacagcccaggaccttcttcttcttccttcctggccggcctctctttagtttcttggtgcggacagggccatcaggccggcctgaggcactgtggacactgccactgtccaggtctgattcctcagcctctggttcaggaccttcgtcgctctgaaaaacatacgagcctcctttcttcctcttgccacccagaagccctagttttattttgagtggtgccattttctttccccgaagcttcttgcgtccatcaggcactcgggggctcttactccgcctcttatggcctggacctttgccctctttggttttggctcttcggatgggtgggggctggatatcagcagcagggggtggtggaagggcggggggtccggagggtgctatgggggtggccgacgagacagcagctgacacctgctcagctacagctgctgctgctgctgccgctgccgccgccacagcagctgctgaccccttgaaggggttgttggcactgaactctctccatttggccccaaggatggtcatcatcttagacattgggatcttaggattcttcttagcaattaggggcctcatgaactggctgaaggctttgtagttggtgagcgtgtggtaatcctcctcagagaacacatgctccacatcctccaggccccaggtcagaagcagagttgctgatgacttctgttccacttgcttttgccccccatctccctccccctttttccgccgctttgtcttcttctcctttttttctcggtgcttccttcttcgtttccgacccggtccggttccatattcactgcccccactctctgacttctcccggtactcatctcgctcagaaccaaattcctcctcactgtcacgcttcttgcgttttcggggttttcctggcttgttctccttctgcttcttgggtcctcgttttctcttcttcacacccaatgctgacggcagcagccgaatgtcatccttatcaggcatcctgtcaccccaacacagtcctggaggaaaagaaatcctcagctggtcatttttacttcttgcccacaggatcacagtgtctgccgccttcatcacacaggagaaagtctccacaattacctaaatattcctcctcccaagtagcctaaaacctaccttcaattctattcccatctccctgctccctttgggaactagggggccataccctttgtttcccgatctcacccttcacctccatattttgttccagatatcctgacccattcatctatacgcagtatgggagacccaaacaaagat

SEQ ID NO: 419377 - DNA, 1900 bp, Homo sapiens
ttgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgttttctcttcttcacacccaatgctgacggcagcagccgaatgtcatccttatctggcggcgggggcggcggcggcgggggcagcggtggcggcggcggcggcggcggcgggaagaggtggcagccgggggggctgtggcggtcgcggccccggtcgtggcccggcccgcgcccgagtactccctcgtcgtcgtcctcctcatcgtcctcgtcggccgcctccacctcctcctcctcctccaaccaatatgactggtgttctcataagaggaagaaattttgacacagacatatatacagggaaatccatgtgaagacacatggagaaaacagccatctacaagatgaggagagagggctcagaagaaaccaaccctgctgacaccctgatcttggacttctggcctttagaatcataacaaaatccatttttattgttgaagccacccactctgtgatacactgctatggcagccctagcaaactaaaacagtgagtaaagagtatatgggtatactctatagcctatattgcaacttatttaaaatcctgaaattatttccaaacaaaaaagtgaattcctactgaacacattttgcacaccaggcattgtacaggaattcttgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgttttctcttcttcacacccaatgctgacggcagcagccgaatgtcatccttatctggcggcgggggcggcggcggcgggggcagcggtggcggcggcggcggcggcggcgggaagaggtggcagccgggggggctgtggcggtcgcggccccggtcgtggcccggcccgcgcccgagtactccctcgtcgtcgtcctcctcatcgtcctcgtcggccgcctccacctcctcctcctcctccaaccaatatgactggtgttctcataagaggaagaaattttgacacagacatatatacagggaaatccatgtgaagacacatggagaaaacagccatctacaagatgaggagagagggctcagaagaaaccaaccctgctgacaccctgatcttggacttctggcctttagaatcataacaaaatccatttttattgttgaagccacccactctgtgatacactgctatggcagccctagcaaactaaaacagtgagtaaagagtatatgggtatactctatagcctatattgcaacttatttaaaatcctgaaattatttccaaacaaaaaagtgaattcctactgaacacattttgcacaccaggcattgtacaggaattc

SEQ ID NO: 419378 - DNA, 1860 bp, Homo sapiens
caatcccttttcagaataaacttgctttataatcaatataatctctgtgcctttgaatctaacaggacacctgggtcccagacgcctgggaattgggtctctcaattccctttggttttggagggaggagtttaaaactgtgcatgggagcaggagggactcaagggtggcagtggtgagtgggaggaaatacactttgggatgactcgttcagccctgagagaggggtgtgagttacccagggaatgggtagggaaggtttaaagcaacacccaaggaaagaagggaaactcatctcttgtagtgattcaaccctgagaacagatggggagtggggttggctgtcccccatggatggatgaaaggtcacctaatcagtagtcaccaggacatagtggtggaggcacaagtggccaaggagtgctcatttggtggagactgggaaagcggctgttatttagtgtctgtgtagtagagggagcgcagctggtcccagaagaagagggagaggatggtgtgggggccgaggcggaagtaggaggcacctatacccttgtacatgccaaaaatgccctcggtccgagctgtctgcagcagagcgtccagtatcccccggtacatgaggcccttgccctgtgcatctgtgggctggttgtagagccttgtgcaggccacatcaaagggtgccatggccaagacaactgcaatgccactcatcatggcagccaccagcgccaacttccagctctggggaggaaagatctgatgcttatactggtgccctacagcaatttctgaggctgcctgtgcctgcaggtgtgtcttcaccatgtagatggggctccccaagtaggctcccatgaccccagccatggccccagctgctgcgctgcgggcaggactgtggggtgccttcggctgtgtgcaggtagcccccagcctcagccagcccataggtgcccagtcggatgccattcatcaggaactggtacaagagggcgggggccaggcctttctgcagggcagcaaggccatccaccttgccgatggtgatgaaggcatggaagacatttcggtagtgccgctggtatgtgccaggggcctgcagttctccttgcaactgcatcctggtcttcaccacctccaggggattggtgaatacacaggccccgcaggctgccaggccactcatcaagaagtccatggtgggatagctgtagcaggaactgacccaagagtaagaaagtaaaaatgggtgtcagaaagcggggttggaagacagggggaaggcctgtttcagcagtacaggttgcagaagataagaatttagatttgcagtcaagggtgtcagggtcaaatgtcaagtggtcaaacgtcagctggaatttgggagtcaagagctggcaagcagggaagagatagaaatctaggagattctggtgagaagcttaaggcaggaccctctgaggtcaaggaggggcaaaagacagaaggttgcaggtgggatggctcaggatggcgggcgacgggagcacgggagtagaggagggaatcgcggggttgggagatggaagccagggaggcaggaagaagaaagccagcaagtgagagaagaaaaggatccgggagaagagccggtgatttcctcgagccagcaacgagatctcgatccgagaaagaagtcaggactctggccaggaatgagcgtccctgagcgtccccaggcagccaccggagctcgcagtagcttcaaccccgggtagcctgcggaggccgggccgccacactcctgccactggagcgcggggccaatggggagccttcaagagccacaaccgaggccctcagccaatcagcgcc

SEQ ID NO: 419379 - DNA, 2001 bp, Homo sapiens
caatcccttttcagaataaacttgctttataatcaatataatctctgtgcctttgaatctaacaggacacctgggtcccagacgcctgggaattgggtctctcaattccctttggttttggagggaggagtttaaaactgtgcatgggagcaggagggactcaagggtggcagtggtgagtgggaggaaatacactttgggatgactcgttcagccctgagagaggggtgtgagttacccagggaatgggtagggaaggtttaaagcaacacccaaggaaagaagggaaactcatctcttgtagtgattcaaccctgagaacagatggggagtggggttggctgtcccccatggatggatgaaaggtcacgcttcttgcgttttcggggttttcctggcttgttctccttctgcttcttgggtcctcgttttctcttcttcacacccaatgctgacggcagcagccgaatgtcatccttatctggcggcgggggcggcggcggcgggggcagcggtggcggcggcggcggcggcggcgggaagaggtggcagccgggggggctgtggcggtcgcggccccggtcgtggcccggcccgcgcccgagtactccctcgtcgtcgtcctcctcatcgtcctcgtcggccgcctccacctcctcctcctcctccaaccaatatgactggtgttctcataagaggaagaaattttgacacagacatatatacagggaaatccatgtgaagacacatggagaaaacagccatctacaagatgaggagagagggctcagaagaaaccaaccctgctgacaccctgatcttggacttctggcctttagaatcataacaaaatccatttttattgttgaagccacccactctgtgatacactgctatggcagccctagcaaactaaaacagtgagtaaagagtatatgggtatactctatagcctatattgcaacttatttaaaatcctgaaattatttccaaacaaaaaagtgaattcctactgaacacattttgcacaccaggcattgtacaggaattcttgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgttttctcttcttcacacccaatgctgacggcagcagccgaatgtcatccttatctggcggcgggggcggcggcggcgggggcagcggtggcggcggcggcggcggcggcgggaagaggtggcagccgggggggctgtggcggtcgcggccccggtcgtggcccggcccgcgcccgagtactccctcgtcgtcgtcctcctcatcgtcctcgtcggccgcctccacctcctcctcctcctccaaccaatatgactggtgttctcataagaggaagaaattttgacacagacatatatacagggaaatccatgtgaagacacatggagaaaacagccatctacaagatgaggagagagggctcagaagaaaccaaccctgctgacaccctgatcttggacttctggcctttagaatcataacaaaatccatttttattgttgaagccacccactctgtgatacactgctatggcagccctagcaaactaaaacagtgagtaaagagtatatgggtatactctatagcctatattgcaacttatttaaaatcctgaaattatttccaaacaaaaaagtgaattcctactgaacacattttgcacaccaggcattgtacaggaattc

SEQ ID NO: 419380 - DNA, 7541 bp, Homo sapiens
cgaacaattaattaaaaaggaggttaattcacagtttacagacttagcatctgcttgtttagcatatgcaataaaaggcgaagttgtggtagatttgcaaaaatgtcagttagataattgattatatatataggaatcattttttgcataatccaaatcctctttttcttttgatgatcctaagatatcattttagaacggaatgtggtatttgtaccctatgtattttatgacttaattattctaagttgaaagaatttatatatttttttgtataccacattcgtcactggatttctggaacttttttaaaaaatcggtgaattgggccgttggtggcggctgtgatgaaggaccctgcaggcatctggctgtaattggcgcctgcggcggccagggcccctacgggtgcggcgctgaaggccgccccgtaccccggaggtgtagcgtagggacccggcgggtaggccggtgtggggtgaggctccgtgcccttgctggccagccggctgaggatgctgcgctcggacatctgaaggcgggctgcgatggggggtattcgggacagcgtggctggcaggcgggtcacgtccgccttcatgtcgctcagcaactcctccagctggttcagaaccttgtgcaggacggcgttggccggcttgttccccgccagcgactccttggagaggtgctggtggctctcggccaggcactcggcctcggcgaagcgggcgtggagggccatggcggggtgcgccggctcctgcgacaggttcaggtaggccgcccgccgcagctgctcctcaatcaccagcgcctgctccaggagcttgaacctccgggccaggaacttatttttcatctccagaaagttccccttattggcttcagttttaaatggctcgttgataatggcaaattgagcatcattctggatgtcctgccaccgtgcatagccatggaggacaatcccagccagaagccaatagtcatgtcttctgtgccagatctcattgagtttccccgaggaaatagctgcccgttcctcattctgccacagtgtgtgaagctctgtgaagccaccatcggcgatattgaacatgaaccggggcttctctgtcttttcctctcgtcgcccattggaccgtggctcatctcgaggccctggtcgaagctcccggtcaccttttacatcttctgacttctctctgtccccacggtacccaggttcaggctccatctctccaggcacccctggcacctcatcctctagaggaatcttccttggctccagccgctccccaagtgatggggctgggctgggggcatcagcctctgtctccatcttctccccaattctgctgttcttctctggcttttcctcctggttttcagcttcctccttctcaagaggtgtccttatgccttctcctttctcacttggagctggagtagcaggtttagaggtgcagggactgttggtagcagaagcctcaggagtggtgggagacgttttggtaggagaggaggctctggaggagcgcttagaatcggcgctggggtcaggcatcagttccggcattgaccaacgcccattgatgtgctcaaactcctgcaccttctttttgacgagagacatgactccaatgcgggtcaacacctgctggcgactcagtccctcccgagggaccccatcggcaaaggtttcagagccgtctgccccaggctcacacagatggcgcatgaacaaagacacataggccttaaactccttctcagtcttgcccctcaggtcccgcaccagccactgtgtggtgaaggcatcctgtggtggcatcccccagcgcatcacagcattgaggaaagccttccgctgacgggtgttgaagcccagcacctcaatgttgcccccgactcgggccagcagtggaggcagtggcttatctttctcattccggagctgcctctttgactgtctacgcccttcaggacgttcatcgaagtcttcatcctcctcctctgaacccaccgagtactctgactggttgtcttggtcttcctgagcagcatcattgtagttaacttgcttgcgaacccgcttgcccttgcctagattccgggctaggtcttcctgctgttgctcatagtgatgcctcagcagcttctcccagtagtcagggtccacattctcctcctgcttgatgatctctcgctcaatttcctcaatcttgtcttcttcccgcacgacgtactgtgccaccttgaaggagctgagatactcattcatgttctgcacgtcagtgtcctcagttgcatcctggttccggtccaacagccgagcgatggcctcattgtcataatgaatcacactgctgtcctcctccttgttctccccctcgttttcatccttgaatagctcttcagtgccaaatttgagaatgtcgtcaagctcctgcttggacatggagcctgccttggagcccagcccaggccgcacaaccaggtgtgtcagcatcatctttctcttggccacttgtgtgattcgctcttccactgacgcgcgagtcacaaaccggtaaatcatcactttgttggcctggccaatccgatgagcccggctaaaggcctggatgtcattatgggggttccagtcagaatcaaagatgatgacagtgtcagcagtggccagattgatgcccaggcccccagctcgggtggacaggaggaagcagaattgttgggccccaggagcattaaaccgatcgatggcctcctgcctcagggcacccgtgataccaccatcgatgcgctcatacttgtagccttcatagtctaagaagtcctcaagcaagtctaacattttggtcatctgcgagaagatgagcactcggtgtccttgctccttcagctttcgcagcatcttctggagcagcatgagcttcccagacgacttaataagtgccccaccctcataagccccactggggagtttgggggactccatagcagccacgggaaaaaggtatggatggttgcagcacttcttaagatccatcatgatattaagcagcgacacctggttcccaccacctcgtgaattcaaggcctcaaaatttcgagtcaggatgtatttgtagtatttcttctgcatggggcttagctccacccgaacgatgagctctgtcttggctggcatgttcttaaagacatctgccttgagtctccgcagcatgtgtggccccagcaaatcatgcagtttcttgatctggtcctctttggatatgtcagcaaactcctccaggaagccctccaagttgttaaatctctctggggtgaggaagttcaggagatggaagagctcctccagattattctgcaatggggttcctgtcagcagcaacttatgatctatcttgtaaccattgagaaccctgaaaaacttggactggttgttcttgagtcgatgggcctcatctaccacaagacaggcccagcggatggaaccaagtgctgcctgatcaatggtgatcagctcatacgatgtcaggagaacatggaacttcacctgtgcctcccttttcatcttaaaagctttcttgccccctttgatggcattgtcctcaaaggagaattcattctcacgaatgatggcccggctgtccttgtcacccgtgtatgtcaccacatagaatttgggtgcccacatctggaactcccgctcccagttaatgatggtagagagtggggcactcaccaggaagggaccttttgtgtggccctccttgtagagtgagtagaggaagacgatggtttgtatggtcttgcctagccccatctcatcagctagaatggtgtcagtgccctgggcccaggagaagcgtagccagttcagcccttccaactgatacatgtgcagggtgcctccagtggctgtgataaaccgtggctgagtctcatatttcacggtaggatcattagtgggagaactgggaggcccatcaccctgtagctccttcttcttcttcttatacttgcggggctgggcagggtcttcccccataattagttctcggtgtctccagtagctttgcttatgttcttcgtattcagggatattcatttcatcttcctcccacgtggactggtcatatggtaagtccctccattttactagatagtggtaattcccctttttatccacactgtggttgatgatgcggtggacggtcatccactctggcttgatgccaaaacgatagtacttctcctccatctcagcatagtgcgggtctttcactttacgcttgtcgctcttcccatcatcctcgccggagccatagtccaggggtgggggctcatccatgtcattcttccgctggtagtttcgatacataaccaaatggaagatttccagctgaagctccttggcccaggagcagtgccagtaggatagtcctacccacttgacaaagaactctcgctctgatctgccttgaagaggacgggggggtgggacatctggatttccatctgcctgttgaggggctggcactgctacaggtggctccccccaccgccaatgtaggatcttctgcactcgacccttcagcacggggcatgtgcatcggggacacagccattcaccattgggaatgtcaggcaggggagggtttagacaatgaatgtggtaggaggagatgcacgcgtcacagcacaggagctccccgccgtccttgcatacgcggcagtactccatgtgatcatcctcctcctccttctccccttcttcctctccctcctcttcgtattcttcttcttcctccttggcctcccactggaccccctccttctcacagtgagggcagctccatttgccctctggagcccggtcaagctcaggatcaaggcagacgaggtggtaggcacgagggcaggtgtcacacagaataatttccccaccctgctggcacacctcacagtaatcctggtgatccgtctcgtagccatcaacctcctcctccccggccactgcaggacagcccaggaccttcttcttcttccttcctggccggcctctctttagtttcttggtgcggacagggccatcaggccggcctgaggcactgtggacactgccactgtccaggtctgattcctcagcctctggttcaggaccttcgtcgctctgaaaaacatacgagcctcctttcttcctcttgccacccagaagccctagttttattttgagtggtgccattttctttccccgaagcttcttgcgtccatcaggcactcgggggctcttactccgcctcttatggcctggacctttgccctctttggttttggctcttcggatgggtgggggctggatatcagcagcagggggtggtggaagggcggggggtccggagggtgctatgggggtggccgacgagacagcagctgacacctgctcagctacagctgctgctgctgctgccgctgccgccgccacagcagctgctgaccccttgaaggggttgttggcactgaactctctccatttggccccaaggatggtcatcatcttagacattgggatcttaggattcttcttagcaattaggggcctcatgaactggctgaaggctttgtagttggtgagcgtgtggtaatcctcctcagagaacacatgctccacatcctccaggccccaggtcagaagcagagttgctgatgacttctgttccacttgcttttgccccccatctccctccccctttttccgccgctttgtcttcttctcctttttttctcggtgcttccttcttcgtttccgacccggtccggttccatattcactgcccccactctctgacttctcccggtactcatctcgctcagaaccaaattcctcctcactgtcacgcttcttgcgttttcggggttttcctggcttgttctccttctgcttcttgggtcctcgttttctcttcttcacacccaatgctgacggcagcagccgaatgtcatccttatctggcggcgggggcggcggcggcgggggcagcggtggcggcggcggcggcggcggcgggaagaggtggcagccgggggggctgtggcggtcgcggccccggtcgtggcccggcccgcgcccgagtactccctcgtcgtcgtcctcctcatcgtcctcgtcggccgcctccacctcctcctcctcctccaaccaatatgactggtgttctcataagaggaagaaattttgacacagacatatatacagggaaatccatgtgaagacacatggagaaaacagccatctacaagatgaggagagagggctcagaagaaaccaaccctgctgacaccctgatcttggacttctggcctttagaatcataacaaaatccatttttattgttgaagccacccactctgtgatacactgctatggcagccctagcaaactaaaacagtgagtaaagagtatatgggtatactctatagcctatattgcaacttatttaaaatcctgaaattatttccaaacaaaaaagtgaattcctactgaacacattttgcacaccaggcattgtacaggaattcttgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgttttctcttcttcacacccaatgctgacggcagcagccgaatgtcatccttatctggcggcgggggcggcggcggcgggggcagcggtggcggcggcggcggcggcggcgggaagaggtggcagccgggggggctgtggcggtcgcggccccggtcgtggcccggcccgcgcccgagtactccctcgtcgtcgtcctcctcatcgtcctcgtcggccgcctccacctcctcctcctcctccaaccaatatgactggtgttctcataagaggaagaaattttgacacagacatatatacagggaaatccatgtgaagacacatggagaaaacagccatctacaagatgaggagagagggctcagaagaaaccaaccctgctgacaccctgatcttggacttctggcctttagaatcataacaaaatccatttttattgttgaagccacccactctgtgatacactgctatggcagccctagcaaactaaaacagtgagtaaagagtatatgggtatactctatagcctatattgcaacttatttaaaatcctgaaattatttccaaacaaaaaagtgaattcctactgaacacattttgcacaccaggcattgtacaggaattc

SEQ ID NO: 419381 - DNA, 2013 bp, Homo sapiens
caatcccttttcagaataaacttgctttataatcaatataatctctgtgcctttgaatctaacaggacacctgggtcccagacgcctgggaattgggtctctcaattccctttggttttggagggaggagtttaaaactgtgcatgggagcaggagggactcaagggtggcagtggtgagtgggaggaaatacactttgggatgactcgttcagccctgagagaggggtgtgagttacccagggaatgggtagggaaggtttaaagcaacacccaaggaaagaagggaaactcatctcttgtagtgattcaaccctgagaacagatggggagtggggttggctgtcccccatggatggatgaaaggtcacctaatcagtagtcaccaggacatagtggtggaggcacaagtggccaaggagtgctcatttggtggagactgggaaagcggctgttatttagtgtctgtgtagtagagggagcgcagctggtcccagaagaagagggagaggatggtgtgggggccgaggcggaagtaggaggcacctatacccttgtacatgccaaaaatgccctcggtccgagctgtctgcagcagagcgtccagtatcccccggtacatgaggcccttgccctgtgcatctgtgggctggttgtagagccttgtgcaggccacatcaaagggtgccatggccaagacaactgcaatgccactcatcatggcagccaccagcgccaacttccagctctggggaggaaagatctcccactggctcaggaggtccttggtggatgagaaggtgcacagctgggtggaggaaccgacgataactcggggcaggccgcccagagccccacgccataaccccaccagaccatgtttctggccaatctcggttagcgcctgaaacatgccctgatgcttatactggtgccctacagcaatttctgaggctgcctgtgcctgcaggtgtgtcttcaccatgtagatggggctccccaagtaggctcccatgaccccagccatggccccagctgctgcgctgcgggcaggactgtggggtgccttcggctgtgtgcaggtagcccccagcctcagccagcccataggtgcccagtcggatgccattcatcaggaactggtacaagagggcgggggccaggcctttctgcagggcagcaaggccatccaccttgccgatggtgatgaaggcatggaagacatttcggtagtgccgctggtatgtgccaggggcctgcagttctccttgcaactgcatcctggtcttcaccacctccaggggattggtgaatacacaggccccgcaggctgccaggccactcatcaagaagtccatggtgggatagctgtagcaggaactgacccaagagtaagaaagtaaaaatgggtgtcagaaagcggggttggaagacagggggaaggcctgtttcagcagtacaggttgcagaagataagaatttagatttgcagtcaagggtgtcagggtcaaatgtcaagtggtcaaacgtcagctggaatttgggagtcaagagctggcaagcagggaagagatagaaatctaggagattctggtgagaagcttaaggcaggaccctctgaggtcaaggaggggcaaaagacagaaggttgcaggtgggatggctcaggatggcgggcgacgggagcacgggagtagaggagggaatcgcggggttgggagatggaagccagggaggcaggaagaagaaagccagcaagtgagagaagaaaaggatccgggagaagagccggtgatttcctcgagccagcaacgagatctcgatccgagaaagaagtcaggactctggccaggaatgagcgtccctgagcgtccccaggcagccaccggagctcgcagtagcttcaaccccgggtagcctgcggaggccgggccgccacactcctgccactggagcgcggggccaatggggagccttcaagagccacaaccgaggccctcagccaatcagcgcc

SEQ ID NO: 419382 - DNA, 1253 bp, Homo sapiens
caatcccttttcagaataaacttgctttataatcaatataatctctgtgcctttgaatctaacaggacacctgggtcccagacgcctgggaattgggtctctcaattccctttggttttggagggaggagtttaaaactgtgcatgggagcaggagggactcaagggtggcagtggtgagtgggaggaaatacactttgggatgactcgttcagccctgagagaggggtgtgagttacccagggaatgggtagggaaggtttaaagcaacacccaaggaaagaagggaaactcatctcttgtagtgattcaaccctgagaacagatggggagtggggttggctgtcccccatggatggatgaaaggtcacctaatcagtagtcaccaggacatagtggtggaggcacaagtggccaaggagtgctcatttggtggagactgggaaagcggctgttatttagtgtctgtgtagtagagggagcgcagctggtcccagaagaagagggagaggatggtgtgggggccgaggcggaagtaggaggcacctatacccttgtacatgccaaaaatgccctcggtccgagctgtctgcagcagagcgtccagtatcccccggtacatgaggcccttgccctgtgcatctgtgggctggttgtagagccttgtgcaggccacatcaaagggtgccatggccaagacaactgcaatgccactcatcatggcagccaccagcgccaacttccagctctggggaggaaagatctcccactggctcaggaggtccttggtggatgagaaggtgcacagctgggtggaggaaccgacgataactcggggcaggccgcccagagccccacgccataaccccaccagaccatgtttctggccaatctcggttagcgcctgaaacatgccctgatgcttatactggtgccctacagcaatttctgaggctgcctgtgcctgcaggtgtgtcttcaccatgtagatggggctccccaagtaggctcccatgaccccagccatggccccagctgctgcgctgcgggcaggactgtggggtgccttcggctgtgtgcaggtagcccccagcctcagccagcccataggtgcccagtcggatgccattcatcaggaactggtacaagagggcgggggccaggcctttctgcagggcagcaaggccatccaccttgccgatggtgatgaaggcatggagtgacgttcctcatccaagatcctctagagcgaca

SEQ ID NO: 419383 - DNA, 6079 bp, Homo sapiens
cgaacaattaattaaaaaggaggttaattcacagtttacagacttagcatctgcttgtttagcatatgcaataaaaggcgaagttgtggtagatttgcaaaaatgtcagttagataattgattatatatataggaatcattttttgcataatccaaatcctctttttcttttgatgatcctaagatatcattttagaacggaatgtggtatttgtaccctatgtattttatgacttaattattctaagttgaaagaatttatatatttttttgtataccacattcgtcactggatttctggaacttttttaaaaaatcggtgaattgggccgttggtggcggctgtgatgaaggaccctgcaggcatctggctgtaattggcgcctgcggcggccagggcccctacgggtgcggcgctgaaggccgccccgtaccccggaggtgtagcgtagggacccggcgggtaggccggtgtggggtgaggctccgtgcccttgctggccagccggctgaggatgctgcgctcggacatctgaaggcgggctgcgatggggggtattcgggacagcgtggctggcaggcgggtcacgtccgccttcatgtcgctcagcaactcctccagctggttcagaaccttgtgcaggacggcgttggccggcttgttccccgccagcgactccttggagaggtgctggtggctctcggccaggcactcggcctcggcgaagcgggcgtggagggccatggcggggtgcgccggctcctgcgacaggttcaggtaggccgcccgccgcagctgctcctcaatcaccagcgcctgctccaggagcttgaacctccgggccaggaacttatttttcatctccagaaagttccccttattggcttcagttttaaatggctcgttgataatggcaaattgagcatcattctggatgtcctgccaccgtgcatagccatggaggacaatcccagccagaagccaatagtcatgtcttctgtgccagatctcattgagtttccccgaggaaatagctgcccgttcctcattctgccacagtgtgtgaagctctgtgaagccaccatcggcgatattgaacatgaaccggggcttctctgtcttttcctctcgtcgcccattggaccgtggctcatctcgaggccctggtcgaagctcccggtcaccttttacatcttctgacttctctctgtccccacggtacccaggttcaggctccatctctccaggcacccctggcacctcatcctctagaggaatcttccttggctccagccgctccccaagtgatggggctgggctgggggcatcagcctctgtctccatcttctccccaattctgctgttcttctctggcttttcctcctggttttcagcttcctccttctcaagaggtgtccttatgccttctcctttctcacttggagctggagtagcaggtttagaggtgcagggactgttggtagcagaagcctcaggagtggtgggagacgttttggtaggagaggaggctctggaggagcgcttagaatcggcgctggggtcaggcatcagttccggcattgaccaacgcccattgatgtgctcaaactcctgcaccttctttttgacgagagacatgactccaatgcgggtcaacacctgctggcgactcagtccctcccgagggaccccatcggcaaaggtttcagagccgtctgccccaggctcacacagatggcgcatgaacaaagacacataggccttaaactccttctcagtcttgcccctcaggtcccgcaccagccactgtgtggtgaaggcatcctgtggtggcatcccccagcgcatcacagcattgaggaaagccttccgctgacgggtgttgaagcccagcacctcaatgttgcccccgactcgggccagcagtggaggcagtggcttatctttctcattccggagctgcctctttgactgtctacgcccttcaggacgttcatcgaagtcttcatcctcctcctctgaacccaccgagtactctgactggttgtcttggtcttcctgagcagcatcattgtagttaacttgcttgcgaacccgcttgcccttgcctagattccgggctaggtcttcctgctgttgctcatagtgatgcctcagcagcttctcccagtagtcagggtccacattctcctcctgcttgatgatctctcgctcaatttcctcaatcttgtcttcttcccgcacgacgtactgtgccaccttgaaggagctgagatactcattcatgttctgcacgtcagtgtcctcagttgcatcctggttccggtccaacagccgagcgatggcctcattgtcataatgaatcacactgctgtcctcctccttgttctccccctcgttttcatccttgaatagctcttcagtgccaaatttgagaatgtcgtcaagctcctgcttggacatggagcctgccttggagcccagcccaggccgcacaaccaggtgtgtcagcatcatctttctcttggccacttgtgtgattcgctcttccactgacgcgcgagtcacaaaccggtaaatcatcactttgttggcctggccaatccgatgagcccggctaaaggcctggatgtcattatgggggttccagtcagaatcaaagatgatgacagtgtcagcagtggccagattgatgcccaggcccccagctcgggtggacaggaggaagcagaattgttgggccccaggagcattaaaccgatcgatggcctcctgcctcagggcacccgtgataccaccatcgatgcgctcatacttgtagccttcatagtctaagaagtcctcaagcaagtctaacattttggtcatctgcgagaagatgagcactcggtgtccttgctccttcagctttcgcagcatcttctggagcagcatgagcttcccagacgacttaataagtgccccaccctcataagccccactggggagtttgggggactccatagcagccacgggaaaaaggtatggatggttgcagcacttcttaagatccatcatgatattaagcagcgacacctggttcccaccacctcgtgaattcaaggcctcaaaatttcgagtcaggatgtatttgtagtatttcttctgcatggggcttagctccacccgaacgatgagctctgtcttggctggcatgttcttaaagacatctgccttgagtctccgcagcatgtgtggccccagcaaatcatgcagtttcttgatctggtcctctttggatatgtcagcaaactcctccaggaagccctccaagttgttaaatctctctggggtgaggaagttcaggagatggaagagctcctccagattattctgcaatggggttcctgtcagcagcaacttatgatctatcttgtaaccattgagaaccctgaaaaacttggactggttgttcttgagtcgatgggcctcatctaccacaagacaggcccagcggatggaaccaagtgctgcctgatcaatggtgatcagctcatacgatgtcaggagaacatggaacttcacctgtgcctcccttttcatcttaaaagctttcttgccccctttgatggcattgtcctcaaaggagaattcattctcacgaatgatggcccggctgtccttgtcacccgtgtatgtcaccacatagaatttgggtgcccacatctggaactcccgctcccagttaatgatggtagagagtggggcactcaccaggaagggaccttttgtgtggccctccttgtagagtgagtagaggaagacgatggtttgtatggtcttgcctagccccatctcatcagctagaatggtgtcagtgccctgggcccaggagaagcgtagccagttcagcccttccaactgatacatgtgcagggtgcctccagtggctgtgataaaccgtggctgagtctcatatttcacggtaggatcattagtgggagaactgggaggcccatcaccctgtagctccttcttcttcttcttatacttgcggggctgggcagggtcttcccccataattagttctcggtgtctccagtagctttgcttatgttcttcgtattcagggatattcatttcatcttcctcccacgtggactggtcatatggtaagtccctccattttactagatagtggtaattcccctttttatccacactgtggttgatgatgcggtggacggtcatccactctggcttgatgccaaaacgatagtacttctcctccatctcagcatagtgcgggtctttcactttacgcttgtcgctcttcccatcatcctcgccggagccatagtccaggggtgggggctcatccatgtcattcttccgctggtagtttcgatacataaccaaatggaagatttccagctgaagctccttggcccaggagcagtgccagtaggatagtcctacccacttgacaaagaactctcgctctgatctgccttgaagaggacgggggggtgggacatctggatttccatctgcctgttgaggggctggcactgctacaggtggctccccccaccgccaatgtaggatcttctgcactcgacccttcagcacggggcatgtgcatcggggacacagccattcaccattgggaatgtcaggcaggggagggtttagacaatgaatgtggtaggaggagatgcacgcgtcacagcacaggagctccccgccgtccttgcatacgcggcagtactccatgtgatcatcctcctcctccttctccccttcttcctctccctcctcttcgtattcttcttcttcctccttggcctcccactggaccccctccttctcacagtgagggcagctccatttgccctctggagcccggtcaagctcaggatcaaggcagacgaggtggtaggcacgagggcaggtgtcacacagaataatttccccaccctgctggcacacctcacagtaatcctggtgatccgtctcgtagccatcaacctcctcctccccggccactgcaggacagcccaggaccttcttcttcttccttcctggccggcctctctttagtttcttggtgcggacagggccatcaggccggcctgaggcactgtggacactgccactgtccaggtctgattcctcagcctctggttcaggaccttcgtcgctctgaaaaacatacgagcctcctttcttcctcttgccacccagaagccctagttttattttgagtggtgccattttctttccccgaagcttcttgcgtccatcaggcactcgggggctcttactccgcctcttatggcctggacctttgccctctttggttttggctcttcggatgggtgggggctggatatcagcagcagggggtggtggaagggcggggggtccggagggtgctatgggggtggccgacgagacagcagctgacacctgctcagctacagctgctgctgctgctgccgctgccgccgccacagcagctgctgaccccttgaaggggttgttggcactgaactctctccatttggccccaaggatggtcatcatcttagacattgggatcttaggattcttcttagcaattaggggcctcatgaactggctgaaggctttgtagttggtgagcgtgtggtaatcctcctcagagaacacatgctccacatcctccaggccccaggtcagaagcagagttgctgatgacttctgttccacttgcttttgccccccatctccctccccctttttccgccgctttgtcttcttctcctttttttctcggtgcttccttcttcgtttccgacccggtccggttccatattcactgcccccactctctgacttctcccggtactcatctcgctcagaaccaaattcctcctcactgtcacgcttcttgcgttttcggggttttcctggcttgttctccttctgcttcttgggtcctcgttttctcttcttcacacccaatgctgacggcagcagccgaatgtcatccttatgcggcggggcggcactgccgagccgggagcgctgccgcttgggcaggtgccgcggccg

SEQ ID NO: 419384 - DNA, 2314 bp, Homo sapiens
ggccgggcggcccggcaagcggcgctgcggggtaggctgctttcctgaggccggactcaacgggtctcggctgagccaccgggtgagctcaccgcccagcccaaaccaggagattgcgagggagcgatgcggtgcagcgcgtgttcttggggaagatcccgactaagccattttccagtggcacctcttccatcatgagttcctgaggcagtccgatggggctactttattccagaacaatcacaatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtaataaagaatccagttctactagagaaagattacgtgaacgtacccgattaaaccagagcaaaaaactaccttctgcaggtcagggagctaatgacatggcattggccaaacgttcccgcagtcgaactgctacagaatgtgacgttcgtatgagcaagtctaagtcagacaatcagatcagtgacagagctgctttggaggccaaagtgaaggatcttctcacgctggcaaaaaccaaagacgtagaaattttacatttgagaaatgaactgcgagacatgcgtgcccagctgggcattaatgaggatcattctgagggtgatgaaaaatctgagaaggaaactattatggctcaccagccgactgatgtggagtccactttattgcagttgcaggaacagaatactgccatccgtgaagaactcaaccagctgaaaaatgaaaacagaatgttaaaggacaggttgaatgcattgggcttttccctagagcagaggttagacaattctgaaaaactgtttggctatcagtccctgagcccagaaatcacccctggtaaccagagcgatggaggaggaactctgacttcttcagtggaaggctctgcccctggctcagtggaggatctcttgagtcaggatgaaaatacactaatggaccatcagcacagtaactccatggacaatttagacagtgagtgcagtgaggtctaccagcccctcacatcgagcgatgatgcgctggatgcaccatcctcctcagagtcggaaggcatccccagcatagagcgctcccggaaggggagcagcgggaatgccagtgaagtgtccgtggcttgcctgactgaacggatacaccagatggaagagaaccaacacagtacaagtgaggaactccaggcaaccctgcaagagctagctgatttacagcagattacccaggaactgaatagtgaaaacgaaaggcttggagaagagaaggttattctgatggagtctttatgtcagcagagcgataagttggaacactttagtcgacagattgaatacttccgctctcttctagatgagcatcacatttcttatgtcatagatgaagatgtaaaaagtgggcgctatatggaattagagcaacgttacatggacctcgctgagaatgcccgttttgaacgggagcagcttcttggtgtccagcagcatttaagcaatactttgaaaatggcagaacaagacaataaggaagctcaagaaatgataggggcactcaaagaacgcagtcaccatatggagcgaattattgagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtagaggatgaataccgagccttccaagaagaagctaagaaacaaattgaagatttgaatatgacgttagaaaaattaagatcagacctggatg

SEQ ID NO: 419385 - DNA, 6161 bp, Homo sapiens
ggccgggcggcccggcaagcggcgctgcggggtaggctgctttcctgaggccggactcaacgggtctcggctgagccaccgggtgagctcaccgcccagcccaaaccaggagattgcgagggagcgatgcggtgcagcgcgatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtaataaagaatccagttctactagagaaagattacgtgaacgtacccgattaaaccagagcaaaaaactaccttctgcaggtcagggagctaatgacatggcattggccaaacgttcccgcagtcgaactgctacagaatgtgacgttcgtatgagcaagtctaagtcagacaatcagatcagtgacagagctgctttggaggccaaagtgaaggatcttctcacgctggcaaaaaccaaagacgtagaaattttacatttgagaaatgaactgcgagacatgcgtgcccagctgggcattaatgaggatcattctgagggtgatgaaaaatctgagaaggaaactattatggctcaccagccgactgatgtggagtccactttattgcagttgcaggaacagaatactgccatccgtgaagaactcaaccagctgaaaaatgaaaacagaatgttaaaggacaggttgaatgcattgggcttttccctagagcagaggttagacaattctgaaaaactgtttggctatcagtccctgagcccagaaatcacccctggtaaccagagcgatggaggaggaactctgacttcttcagtggaaggctctgcccctggctcagtggaggatctcttgagtcaggatgaaaatacactaatggaccatcagcacagtaactccatggacaatttagacagtgagtgcagtgaggtctaccagcccctcacatcgagcgatgatgcgctggatgcaccatcctcctcagagtcggaaggcatccccagcatagagcgctcccggaaggggagcagcgggaatgccagtgaagtgtccgtggcttgcctgactgaacggatacaccagatggaagagaaccaacacagtacaagtgaggaactccaggcaaccctgcaagagctagctgatttacagcagattacccaggaactgaatagtgaaaacgaaaggcttggagaagagaaggttattctgatggagtctttatgtcagcagagcgataagttggaacactttagtcgacagattgaatacttccgctctcttctagatgagcatcacatttcttatgtcatagatgaagatgtaaaaagtgggcgctatatggaattagagcaacgttacatggacctcgctgagaatgcccgttttgaacgggagcagcttcttggtgtccagcagcatttaagcaatactttgaaaatggcagaacaagacaataaggaagctcaagaaatgataggggcactcaaagaacgcagtcaccatatggagcgaattattgagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtagaggatgaataccgagccttccaagaagaagctaagaaacaaattgaagatttgaatatgacgttagaaaaattaagatcagacctggatgaaaaagaaacagaaaggagtgacatgaaagaaaccatctttgaacttgaagatgaagtagaacaacatcgtgctgtgaaacttcatgacaacctcattatttctgatctagagaatacagttaaaaaactccaggaccaaaagcacgacatggaaagagaaataaagacactccacagaagacttcgggaagaatctgcggaatggcggcagtttcaggctgatctccagactgcagtagtcattgcaaatgacattaaatctgaagcccaagaggagattggtgatctaaagcgccggttacatgaggctcaagaaaaaaatgagaaactcacaaaagaattggaggaaataaagtcacgcaagcaagaggaggagcgaggccgggtatacaattacatgaatgccgttgagagagatttggcagccttaaggcagggaatgggactgagtagaaggtcctcgacttcctcagagccaactcctacagtaaaaaccctcatcaagtcctttgacagtgcatctcaagtaccaaaccctgctgcagctgcaattcctcgaacgcccctgagcccaagtcctatgaaaacccctcctgcagcagctgtgtcccctatgcagagacattccataagtggaccaatctcaacatccaaacccctgacagccctgtcagataagagaccaaactatggggaaatccctgttcaagagcatctgttaagaacatcttcagccagccggcctgcttccctgccaagagtgcctgcgatggaaagtgccaagaccctctcagtgtctcgacgaagtagtgaagaaatgaaacgggacatttctgcacaggagggagcgtcgccagcctctctgatggctatgggaaccacgtctccacagctttccctgtcctcttctccaacggcatctgtgactcccaccacccgaagccgaataagagaagaaaggaaagaccctctctcagcattggccagagaatatggaggatcaaagaggaacgccttgctgaagtggtgtcagaagaaaacagaaggctatcagaatattgacattacaaacttcagcagcagctggaatgatgggctggccttctgtgccctcctgcatacatatctccctgcccacattccatatcaagaactgaacagccaggataagagaaggaacttcatgctggctttccaggcagctgaaagtgtcggcatcaaatccacactggacattaatgaaatggtacggactgaacgacccgactggcagaacgtgatgctgtatgtgacggcgatctacaagtactttgagacctgagcatgccgggaggagccgccccaatagcgggggtacccctccacagcgaccgagcgacaccgacgccattagctacgcacccctgtaaagcttccagcaactctgggctgccccacagcgtgtgagcctccagctcggggcttccgtattggaagaactcagccgtgtggcccacagctcccaccagggcccctcccacatgacccgtccattcaggtcatgtgggctcagcacacatcctgcaggccggtggctgctggagttttccttctgaagagaatattgaactacactagtgctccagggcaccaaacaaaaagggctcatgcacagctgaatttgggaaaagggattcagttctgtgggaaactcactagggttgatgaaggctcggccgcggcacttcctgactattggctggggtgggttccggtgctggtgagaacccagaaggagagtcagcgcctggcagttcccagcgccctgggcccttcaccgtcctagtttggaggagcatgttcaccacagacgtgggtcagctgccccacacctgacggggctgtcccggccgacacaatccaggcgtgttcagcctgagctaggagagtatctagagggcgtggtgcgggcacgccagggctggggtgctgctgctgcactcacgcggctgggctttctggcgggaagcagttacgggggccccttgcctggactcagcgacctgtcttccagcctggaaggggtttggagtcccagctctggctttagatttcttcatcataaggagtttttctagttaacatttttgttttgttacgagcaatgctggaaaaggtcgctcctgttctgttagtaccaaagttacattgtttcaataagcatagaaatctaaacaacatctgtacattagcatggtgagagcaaggaataaagcaggaaataggagaaaagtaaacaactttagggagcccaggcagtgtcatttaaactcactgagtcactaagacataattctcctaggccagagttaaagaaagtgccttaactcttcttgtgagggcagccactgccctccatggccaaggcaggacctccaagactcagtggttgagttgtctcctaccaccatgcccgccctccccaggtactgggtccatgccccctgtgcccaccctccccaggtgctgggtccatgctgtttgaaccaaagccttatttaaaggtggtcactggagatgctctcaggccagaactcaacagctatttttgggaatagggatctcccgtgtgcctaacgcagtagctattggtttgaacaatgtccagacaagacctgtacctttgagaatataactgtgtttggcacctgcatagcaccatgaggaagaccagccaccagtggaagcggggtcactgccccacagactggatgcaatgaggggctcacaggaggcccagccagcccgattgtgggctgaggggtctgcattcaagcacgatgttctagaataggagtttaacgtgtctacgtaacctagaatgtggttattaggaaaggggctgtgcatgtgggtgcagctggcggcacacctggtcaccagatggccagaagctgcccatcagccctgcccagatgtcagcctgggagctcaggctgctgccgctggctggatgccctttggtgaaatgcctgttttcagctaagaaaggagaggccaggcaagcaaagtcatgccacaaagcatatcagagacccccgcagactcctggccccgtcccgccccccgtctgagttgtgtttttgttgctgttcctctgttgatggccagctctgctgttggcatgagccactgatgttcatgtgagaattactgtttttaagtgtctctccacttaggtgtcctcagttcccacttttgctctcatttgccttcacagaggccactccacctgtccggatccagctgtctggtcatggtttggtttatttattttgtccttcaggggctgttttgccctaagaatgagggggcttcccctggtctgcagttcccaactttatcccttgctggccatgcgagcccagccctggtgcctcatgggatgggggggtaggggtccccaggatcttctggaggaaggtggccatggatggatgggctgtatctgtgttttccctctgggagtctcatgggtccagcatcaggcctgaggtcagcaacagggaaagagggtgggcacggggagggcttggccccgcctatctagaggcttgcctcgggcccctccttggggaaggtttgcgtgcagagctgcaagggagagggttccagaagcattgccttttgcctcgtctaataggatccttaggacactgtgggctttaggaatgactatagatgctcacacgtgtttaaagtgacatttggagatgctctcagtcctgtggcatctggcacgaagtctccaagaagccactttgcctcttctcccttcaagcacaagctttactgcaaaagggccagtcgcgtttctatttctctcgatcccaggcttctgcggaccgacgatacgtttaaatgttgttctagtaaatattcttgaatgtattaaaatggctgaaacaaca

SEQ ID NO: 419386 - DNA, 2955 bp, Homo sapiens
tatacgcgctaggtagaggccggggtgtaatcggccgagggaaaacagaaggctatcagaatattgacattacaaacttcagcagcagctggaatgatgggctggccttctgtgccctcctgcatacatatctccctgcccacattccatatcaagaactgaacagccaggataagagaaggaacttcatgctggctttccaggcagctgaaagtgtcggcatcaaatccacactggacattaatgaaatggtacggactgaacgacccgactggcagaacgtgatgctgtatgtgacggcgatctacaagtactttgagacctgagcatgccgggaggagccgccccaatagcgggggtacccctccacagcgaccgagcgacaccgacgccattagctacgcacccctgtaaagcttccagcaactctgggctgccccacagcgtgtgagcctccagctcggggcttccgtattggaagaactcagccgtgtggcccacagctcccaccagggcccctcccacatgacccgtccattcaggtcatgtgggctcagcacacatcctgcaggccggtggctgctggagttttccttctgaagagaatattgaactacactagtgctccagggcaccaaacaaaaagggctcatgcacagctgaatttgggaaaagggattcagttctgtgggaaactcactagggttgatgaaggctcggccgcggcacttcctgactattggctggggtgggttccggtgctggtgagaacccagaaggagagtcagcgcctggcagttcccagcgccctgggcccttcaccgtcctagtttggaggagcatgttcaccacagacgtgggtcagctgccccacacctgacggggctgtcccggccgacacaatccaggcgtgttcagcctgagctaggagagtatctagagggcgtggtgcgggcacgccagggctggggtgctgctgctgcactcacgcggctgggctttctggcgggaagcagttacgggggccccttgcctggactcagcgacctgtcttccagcctggaaggggtttggagtcccagctctggctttagatttcttcatcataaggagtttttctagttaacatttttgttttgttacgagcaatgctggaaaaggtcgctcctgttctgttagtaccaaagttacattgtttcaataagcatagaaatctaaacaacatctgtacattagcatggtgagagcaaggaataaagcaggaaataggagaaaagtaaacaactttagggagcccaggcagtgtcatttaaactcactgagtcactaagacataattctcctaggccagagttaaagaaagtgccttaactcttcttgtgagggcagccactgccctccatggccaaggcaggacctccaagactcagtggttgagttgtctcctaccaccatgcccgccctccccaggtactgggtccatgccccctgtgcccaccctccccaggtgctgggtccatgctgtttgaaccaaagccttatttaaaggtggtcactggagatgctctcaggccagaactcaacagctatttttgggaatagggatctcccgtgtgcctaacgcagtagctattggtttgaacaatgtccagacaagacctgtacctttgagaatataactgtgtttggcacctgcatagcaccatgaggaagaccagccaccagtggaagcggggtcactgccccacagactggatgcaatgaggggctcacaggaggcccagccagcccgattgtgggctgaggggtctgcattcaagcacgatgttctagaataggagtttaacgtgtctacgtaacctagaatgtggttattaggaaaggggctgtgcatgtgggtgcagctggcggcacacctggtcaccagatggccagaagctgcccatcagccctgcccagatgtcagcctgggagctcaggctgctgccgctggctggatgccctttggtgaaatgcctgttttcagctaagaaaggagaggccaggcaagcaaagtcatgccacaaagcatatcagagacccccgcagactcctggccccgtcccgccccccgtctgagttgtgtttttgttgctgttcctctgttgatggccagctctgctgttggcatgagccactgatgttcatgtgagaattactgtttttaagtgtctctccacttaggtgtcctcagttcccacttttgctctcatttgccttcacagaggccactccacctgtccggatccagctgtctggtcatggtttggtttatttattttgtccttcaggggctgttttgccctaagaatgagggggcttcccctggtctgcagttcccaactttatcccttgctggccatgcgagcccagccctggtgcctcatgggatgggggggtaggggtccccaggatcttctggaggaaggtggccatggatggatgggctgtatctgtgttttccctctgggagtctcatgggtccagcatcaggcctgaggtcagcaacagggaaagagggtgggcacggggagggcttggccccgcctatctagaggcttgcctcgggcccctccttggggaaggtttgcgtgcagagctgcaagggagagggttccagaagcattgccttttgcctcgtctaataggatccttaggacactgtgggctttaggaatgactatagatgctcacacgtgtttaaagtgacatttggagatgctctcagtcctgtggcatctggcacgaagtctccaagaagccactttgcctcttctcccttcaagcacaagctttactgcaaaagggccagtcgcgtttctatttctctcgatcccaggcttctgcggaccgacgatacgtttaaatgttgttctagtaaatattcttgaatgtattaaaatggctgaaacaaca

SEQ ID NO: 419387 - DNA, 1505 bp, Homo sapiens
  misc_feature (25)..(25): n is a, c, g, or t
acccaggatcttctggaggaaggtnggccatgagatgggctgtatctgtgttttccctctgggagtccatgctgtttgaaccaaagccttatttaaaggtggtcactggagatgctctcaggccagaactcaacagctatttttgggaatagggatctcccgtgtgcctaacgcagtagctattggtttgaacaatgtccagacaagacctgtacctttgagaatataactgtgtttggcacctgcatagcaccatgaggaagaccagccaccagtggaagcggggtcactgccccacagactggatgcaatgaggggctcacaggaggcccagccagcccgattgtgggctgaggggtctgcattcaagcacgatgttctagaataggagtttaacgtgtctacgtaacctagaatgtggttattaggaaaggggctgtgcatgtgggtgcagctggcggcacacctggtcaccagatggccagaagctgcccatcagccctgcccagatgtcagcctgggagctcaggctgctgccgctggctggatgccctttggtgaaatgcctgttttcagctaagaaaggagaggccaggcaagcaaagtcatgccacaaagcatatcagagacccccgcagactcctggccccgtcccgccccccgtctgagttgtgtttttgttgctgttcctctgttgatggccagctctgctgttggcatgagccactgatgttcatgtgagaattactgtttttaagtgtctctccacttaggtgtcctcagttcccacttttgctctcatttgccttcacagaggccactccacctgtccggatccagctgtctggtcatggtttggtttatttattttgtccttcaggggctgttttgccctaagaatgagggggcttcccctggtctgcagttcccaactttatcccttgctggccatgcgagcccagccctggtgcctcatgggatgggggggtaggggtccccaggatcttctggaggaaggtggccatggatggatgggctgtatctgtgttttccctctgggagtctcatgggtccagcatcaggcctgaggtcagcaacagggaaagagggtgggcacggggagggcttggccccgcctatctagaggcttgcctcgggcccctccttggggaaggtttgcgtgcagagctgcaagggagagggttccagaagcattgccttttgcctcgtctaataggatccttaggacactgtgggctttaggaatgactatagatgctcacacgtgtttaaagtgacatttggagatgctctcagtcctgtggcatctggcacgaagtctccaagaagccactttgcctcttctcccttcaagcacaagctttactgcaaaagggccagtcgcgtttctatttctctcgatcccaggcttctgcggaccgacgatacgtttaaatgttgttctagtaaatattcttgaatgtattaaaatggctgaaacaaca

SEQ ID NO: 419388 - DNA, 183 bp, Homo sapiens
taaaactctttagcaaactagaaatagaaggagacctgtgggaactccacagctaacgtcatacttaatctggagactgaatgctttcccaccaggatcaggagcaaggtaaggatacccactgtcaccacttttgttcagcattttgctggagctcttaccctgtgcaattgcataagacca

SEQ ID NO: 419389 - DNA, 350 bp, Homo sapiens
aatgaagaagcaggaaaatgtcacctataaccaggggaaaaatcagtcaatagatgcagacctagaacggatagaaatgataggattagcatgcagcaatgtaaatatgatctctgcttaagtatgtgaagggaagcatgcacagatgaagagagaagtgaaagatatgaaaaagaatagaggaggccaggtatggtgactcacgcctgtaatcccagcactttgggaggccaaggcaggtggatcacctgaggtcaggagttcaagaccagcctggccaacatggcgaaaccccatctctactaaaactacaaaaaaattagccaggcacggtggtgtgtgcctgtaat

SEQ ID NO: 419390 - DNA, 6265 bp, Homo sapiens
ggccgggcggcccggcaagcggcgctgcggggtaggctgctttcctgaggccggactcaacgggtctcggctgagccaccgggtgagctcaccgcccagcccaaaccaggagattgcgagggagcgatgcggtgcagcgcgtgttcttggggaagatcccgactaagccattttccagtggcacctcttccatcatgagttcctgaggcagtccgatggggctactttattccagaacaatcacaatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtaataaagaatccagttctactagagaaagattacgtgaacgtacccgattaaaccagagcaaaaaactaccttctgcaggtcagggagctaatgacatggcattggccaaacgttcccgcagtcgaactgctacagaatgtgacgttcgtatgagcaagtctaagtcagacaatcagatcagtgacagagctgctttggaggccaaagtgaaggatcttctcacgctggcaaaaaccaaagacgtagaaattttacatttgagaaatgaactgcgagacatgcgtgcccagctgggcattaatgaggatcattctgagggtgatgaaaaatctgagaaggaaactattatggctcaccagccgactgatgtggagtccactttattgcagttgcaggaacagaatactgccatccgtgaagaactcaaccagctgaaaaatgaaaacagaatgttaaaggacaggttgaatgcattgggcttttccctagagcagaggttagacaattctgaaaaactgtttggctatcagtccctgagcccagaaatcacccctggtaaccagagcgatggaggaggaactctgacttcttcagtggaaggctctgcccctggctcagtggaggatctcttgagtcaggatgaaaatacactaatggaccatcagcacagtaactccatggacaatttagacagtgagtgcagtgaggtctaccagcccctcacatcgagcgatgatgcgctggatgcaccatcctcctcagagtcggaaggcatccccagcatagagcgctcccggaaggggagcagcgggaatgccagtgaagtgtccgtggcttgcctgactgaacggatacaccagatggaagagaaccaacacagtacaagtgaggaactccaggcaaccctgcaagagctagctgatttacagcagattacccaggaactgaatagtgaaaacgaaaggcttggagaagagaaggttattctgatggagtctttatgtcagcagagcgataagttggaacactttagtcgacagattgaatacttccgctctcttctagatgagcatcacatttcttatgtcatagatgaagatgtaaaaagtgggcgctatatggaattagagcaacgttacatggacctcgctgagaatgcccgttttgaacgggagcagcttcttggtgtccagcagcatttaagcaatactttgaaaatggcagaacaagacaataaggaagctcaagaaatgataggggcactcaaagaacgcagtcaccatatggagcgaattattgagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtagaggatgaataccgagccttccaagaagaagctaagaaacaaattgaagatttgaatatgacgttagaaaaattaagatcagacctggatgaaaaagaaacagaaaggagtgacatgaaagaaaccatctttgaacttgaagatgaagtagaacaacatcgtgctgtgaaacttcatgacaacctcattatttctgatctagagaatacagttaaaaaactccaggaccaaaagcacgacatggaaagagaaataaagacactccacagaagacttcgggaagaatctgcggaatggcggcagtttcaggctgatctccagactgcagtagtcattgcaaatgacattaaatctgaagcccaagaggagattggtgatctaaagcgccggttacatgaggctcaagaaaaaaatgagaaactcacaaaagaattggaggaaataaagtcacgcaagcaagaggaggagcgaggccgggtatacaattacatgaatgccgttgagagagatttggcagccttaaggcagggaatgggactgagtagaaggtcctcgacttcctcagagccaactcctacagtaaaaaccctcatcaagtcctttgacagtgcatctcaagtaccaaaccctgctgcagctgcaattcctcgaacgcccctgagcccaagtcctatgaaaacccctcctgcagcagctgtgtcccctatgcagagacattccataagtggaccaatctcaacatccaaacccctgacagccctgtcagataagagaccaaactatggggaaatccctgttcaagagcatctgttaagaacatcttcagccagccggcctgcttccctgccaagagtgcctgcgatggaaagtgccaagaccctctcagtgtctcgacgaagtagtgaagaaatgaaacgggacatttctgcacaggagggagcgtcgccagcctctctgatggctatgggaaccacgtctccacagctttccctgtcctcttctccaacggcatctgtgactcccaccacccgaagccgaataagagaagaaaggaaagaccctctctcagcattggccagagaatatggaggatcaaagaggaacgccttgctgaagtggtgtcagaagaaaacagaaggctatcagaatattgacattacaaacttcagcagcagctggaatgatgggctggccttctgtgccctcctgcatacatatctccctgcccacattccatatcaagaactgaacagccaggataagagaaggaacttcatgctggctttccaggcagctgaaagtgtcggcatcaaatccacactggacattaatgaaatggtacggactgaacgacccgactggcagaacgtgatgctgtatgtgacggcgatctacaagtactttgagacctgagcatgccgggaggagccgccccaatagcgggggtacccctccacagcgaccgagcgacaccgacgccattagctacgcacccctgtaaagcttccagcaactctgggctgccccacagcgtgtgagcctccagctcggggcttccgtattggaagaactcagccgtgtggcccacagctcccaccagggcccctcccacatgacccgtccattcaggtcatgtgggctcagcacacatcctgcaggccggtggctgctggagttttccttctgaagagaatattgaactacactagtgctccagggcaccaaacaaaaagggctcatgcacagctgaatttgggaaaagggattcagttctgtgggaaactcactagggttgatgaaggctcggccgcggcacttcctgactattggctggggtgggttccggtgctggtgagaacccagaaggagagtcagcgcctggcagttcccagcgccctgggcccttcaccgtcctagtttggaggagcatgttcaccacagacgtgggtcagctgccccacacctgacggggctgtcccggccgacacaatccaggcgtgttcagcctgagctaggagagtatctagagggcgtggtgcgggcacgccagggctggggtgctgctgctgcactcacgcggctgggctttctggcgggaagcagttacgggggccccttgcctggactcagcgacctgtcttccagcctggaaggggtttggagtcccagctctggctttagatttcttcatcataaggagtttttctagttaacatttttgttttgttacgagcaatgctggaaaaggtcgctcctgttctgttagtaccaaagttacattgtttcaataagcatagaaatctaaacaacatctgtacattagcatggtgagagcaaggaataaagcaggaaataggagaaaagtaaacaactttagggagcccaggcagtgtcatttaaactcactgagtcactaagacataattctcctaggccagagttaaagaaagtgccttaactcttcttgtgagggcagccactgccctccatggccaaggcaggacctccaagactcagtggttgagttgtctcctaccaccatgcccgccctccccaggtactgggtccatgccccctgtgcccaccctccccaggtgctgggtccatgctgtttgaaccaaagccttatttaaaggtggtcactggagatgctctcaggccagaactcaacagctatttttgggaatagggatctcccgtgtgcctaacgcagtagctattggtttgaacaatgtccagacaagacctgtacctttgagaatataactgtgtttggcacctgcatagcaccatgaggaagaccagccaccagtggaagcggggtcactgccccacagactggatgcaatgaggggctcacaggaggcccagccagcccgattgtgggctgaggggtctgcattcaagcacgatgttctagaataggagtttaacgtgtctacgtaacctagaatgtggttattaggaaaggggctgtgcatgtgggtgcagctggcggcacacctggtcaccagatggccagaagctgcccatcagccctgcccagatgtcagcctgggagctcaggctgctgccgctggctggatgccctttggtgaaatgcctgttttcagctaagaaaggagaggccaggcaagcaaagtcatgccacaaagcatatcagagacccccgcagactcctggccccgtcccgccccccgtctgagttgtgtttttgttgctgttcctctgttgatggccagctctgctgttggcatgagccactgatgttcatgtgagaattactgtttttaagtgtctctccacttaggtgtcctcagttcccacttttgctctcatttgccttcacagaggccactccacctgtccggatccagctgtctggtcatggtttggtttatttattttgtccttcaggggctgttttgccctaagaatgagggggcttcccctggtctgcagttcccaactttatcccttgctggccatgcgagcccagccctggtgcctcatgggatgggggggtaggggtccccaggatcttctggaggaaggtggccatggatggatgggctgtatctgtgttttccctctgggagtctcatgggtccagcatcaggcctgaggtcagcaacagggaaagagggtgggcacggggagggcttggccccgcctatctagaggcttgcctcgggcccctccttggggaaggtttgcgtgcagagctgcaagggagagggttccagaagcattgccttttgcctcgtctaataggatccttaggacactgtgggctttaggaatgactatagatgctcacacgtgtttaaagtgacatttggagatgctctcagtcctgtggcatctggcacgaagtctccaagaagccactttgcctcttctcccttcaagcacaagctttactgcaaaagggccagtcgcgtttctatttctctcgatcccaggcttctgcggaccgacgatacgtttaaatgttgttctagtaaatattcttgaatgtattaaaatggctgaaacaaca

SEQ ID NO: 419391 - DNA, 3728 bp, Homo sapiens
acagtagtgtacttatttgccaaagtaataatttttaaaggaatacagcaaaatataagactccatcataatctggcatgcaataaaaaattactagacaatgaagaagcaggaaaatgtcacctataaccaggggaaaaatcagtcaatagatgcagacctagaacggatagaaatgataggattagcatgcagcaatgtaaatatgatctctgcttaagtatgtgaagggaagcatgcacagatgaagagagaagtgaaagatatgaaaaagaatagaggaggccagtaaaactctttagcaaactagaaatagaaggagacctgtgggaactccacagctaacgtcatacttaatctggagactgaatgctttcccaccaggatcaggagcaagagacattccataagtggaccaatctcaacatccaaacccctgacagccctgtcagataagagaccaaactatggggaaatccctgttcaagagcatctgttaagaacatcttcagccagccggcctgcttccctgccaagagtgcctgcgatggaaagtgccaagaccctctcagtgtctcgacgaagtagtgaagaaatgaaacgggacatttctgcacaggagggagcgtcgccagcctctctgatggctatgggaaccacgtctccacagctttccctgtcctcttctccaacggcatctgtgactcccaccacccgaagccgaataagagaagaaaggaaagaccctctctcagcattggccagagaatatggaggatcaaagaggaacgccttgctgaagtggtgtcagaagaaaacagaaggctatcagaatattgacattacaaacttcagcagcagctggaatgatgggctggccttctgtgccctcctgcatacatatctccctgcccacattccatatcaagaactgaacagccaggataagagaaggaacttcatgctggctttccaggcagctgaaagtgtcggcatcaaatccacactggacattaatgaaatggtacggactgaacgacccgactggcagaacgtgatgctgtatgtgacggcgatctacaagtactttgagacctgagcatgccgggaggagccgccccaatagcgggggtacccctccacagcgaccgagcgacaccgacgccattagctacgcacccctgtaaagcttccagcaactctgggctgccccacagcgtgtgagcctccagctcggggcttccgtattggaagaactcagccgtgtggcccacagctcccaccagggcccctcccacatgacccgtccattcaggtcatgtgggctcagcacacatcctgcaggccggtggctgctggagttttccttctgaagagaatattgaactacactagtgctccagggcaccaaacaaaaagggctcatgcacagctgaatttgggaaaagggattcagttctgtgggaaactcactagggttgatgaaggctcggccgcggcacttcctgactattggctggggtgggttccggtgctggtgagaacccagaaggagagtcagcgcctggcagttcccagcgccctgggcccttcaccgtcctagtttggaggagcatgttcaccacagacgtgggtcagctgccccacacctgacggggctgtcccggccgacacaatccaggcgtgttcagcctgagctaggagagtatctagagggcgtggtgcgggcacgccagggctggggtgctgctgctgcactcacgcggctgggctttctggcgggaagcagttacgggggccccttgcctggactcagcgacctgtcttccagcctggaaggggtttggagtcccagctctggctttagatttcttcatcataaggagtttttctagttaacatttttgttttgttacgagcaatgctggaaaaggtcgctcctgttctgttagtaccaaagttacattgtttcaataagcatagaaatctaaacaacatctgtacattagcatggtgagagcaaggaataaagcaggaaataggagaaaagtaaacaactttagggagcccaggcagtgtcatttaaactcactgagtcactaagacataattctcctaggccagagttaaagaaagtgccttaactcttcttgtgagggcagccactgccctccatggccaaggcaggacctccaagactcagtggttgagttgtctcctaccaccatgcccgccctccccaggtactgggtccatgccccctgtgcccaccctccccaggtgctgggtccatgctgtttgaaccaaagccttatttaaaggtggtcactggagatgctctcaggccagaactcaacagctatttttgggaatagggatctcccgtgtgcctaacgcagtagctattggtttgaacaatgtccagacaagacctgtacctttgagaatataactgtgtttggcacctgcatagcaccatgaggaagaccagccaccagtggaagcggggtcactgccccacagactggatgcaatgaggggctcacaggaggcccagccagcccgattgtgggctgaggggtctgcattcaagcacgatgttctagaataggagtttaacgtgtctacgtaacctagaatgtggttattaggaaaggggctgtgcatgtgggtgcagctggcggcacacctggtcaccagatggccagaagctgcccatcagccctgcccagatgtcagcctgggagctcaggctgctgccgctggctggatgccctttggtgaaatgcctgttttcagctaagaaaggagaggccaggcaagcaaagtcatgccacaaagcatatcagagacccccgcagactcctggccccgtcccgccccccgtctgagttgtgtttttgttgctgttcctctgttgatggccagctctgctgttggcatgagccactgatgttcatgtgagaattactgtttttaagtgtctctccacttaggtgtcctcagttcccacttttgctctcatttgccttcacagaggccactccacctgtccggatccagctgtctggtcatggtttggtttatttattttgtccttcaggggctgttttgccctaagaatgagggggcttcccctggtctgcagttcccaactttatcccttgctggccatgcgagcccagccctggtgcctcatgggatgggggggtaggggtccccaggatcttctggaggaaggtggccatggatggatgggctgtatctgtgttttccctctgggagtctcatgggtccagcatcaggcctgaggtcagcaacagggaaagagggtgggcacggggagggcttggccccgcctatctagaggcttgcctcgggcccctccttggggaaggtttgcgtgcagagctgcaagggagagggttccagaagcattgccttttgcctcgtctaataggatccttaggacactgtgggctttaggaatgactatagatgctcacacgtgtttaaagtgacatttggagatgctctcagtcctgtggcatctggcacgaagtctccaagaagccactttgcctcttctcccttcaagcacaagctttactgcaaaagggccagtcgcgtttctatttctctcgatcccaggcttctgcggaccgacgatacgtttaaatgttgttctagtaaatattcttgaatgtattaaaatggctgaaacaaca

SEQ ID NO: 419392 - DNA, 6758 bp, Homo sapiens
ggccgggcggcccggcaagcggcgctgcggggtaggctgctttcctgaggccggactcaacgggtctcggctgagccaccgggtgagctcaccgcccagcccaaaccaggagattgcgagggagcgatgcggtgcagcgcgtgttcttggggaagatcccgactaagccattttccagtggcacctcttccatcatgagttcctgaggcagtccgatggggctactttattccagaacaatcacaatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtaataaagaatccagttctactagagaaagattacgtgaacgtacccgattaaaccagagcaaaaaactaccttctgcaggtcagggagctaatgacatggcattggccaaacgttcccgcagtcgaactgctacagaatgtgacgttcgtatgagcaagtctaagtcagacaatcagatcagtgacagagctgctttggaggccaaagtgaaggatcttctcacgctggcaaaaaccaaagacgtagaaattttacatttgagaaatgaactgcgagacatgcgtgcccagctgggcattaatgaggatcattctgagggtgatgaaaaatctgagaaggaaactattatggctcaccagccgactgatgtggagtccactttattgcagttgcaggaacagaatactgccatccgtgaagaactcaaccagctgaaaaatgaaaacagaatgttaaaggacaggttgaatgcattgggcttttccctagagcagaggttagacaattctgaaaaactgtttggctatcagtccctgagcccagaaatcacccctggtaaccagagcgatggaggaggaactctgacttcttcagtggaaggctctgcccctggctcagtggaggatctcttgagtcaggatgaaaatacactaatggaccatcagcacagtaactccatggacaatttagacagtgagtgcagtgaggtctaccagcccctcacatcgagcgatgatgcgctggatgcaccatcctcctcagagtcggaaggcatccccagcatagagcgctcccggaaggggagcagcgggaatgccagtgaagtgtccgtggcttgcctgactgaacggatacaccagatggaagagaaccaacacagtacaagtgaggaactccaggcaaccctgcaagagctagctgatttacagcagattacccaggaactgaatagtgaaaacgaaaggcttggagaagagaaggttattctgatggagtctttatgtcagcagagcgataagttggaacactttagtcgacagattgaatacttccgctctcttctagatgagcatcacatttcttatgtcatagatgaagatgtaaaaagtgggcgctatatggaattagagcaacgttacatggacctcgctgagaatgcccgttttgaacgggagcagcttcttggtgtccagcagcatttaagcaatactttgaaaatggcagaacaagacaataaggaagctcaagaaatgataggggcactcaaagaacgcagtcaccatatggagcgaattattgagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtagaggatgaataccgagccttccaagaagaagctaagaaacaaattgaagatttgaatatgacgttagaaaaattaagatcagacctggatgaaaaagaaacagaaaggagtgacatgaaagaaaccatctttgaacttgaagatgaagtagaacaacatcgtgctgtgaaacttcatgacaacctcattatttctgatctagagaatacagttaaaaaactccaggaccaaaagcacgacatggaaagagaaataaagacactccacagaagacttcgggaagaatctgcggaatggcggcagtttcaggctgatctccagactgcagtagtcattgcaaatgacattaaatctgaagcccaagaggagattggtgatctaaagcgccggttacatgaggctcaagaaaaaaatgagaaactcacaaaagaattggaggaaataaagtcacgcaagcaagaggaggagcgaggccgggtatacaattacatgaatgccgttgagagagatttggcagccttaaggcagggaatgggactgagtagaaggtcctcgacttcctcagagccaactcctacagtaaaaaccctcatcaagtcctttgacagtgcatctcaagtaccaaaccctgctgcagctgcaattcctcgaacgcccctgagcccaagtcctatgaaaacccctcctgcagcagctgtgtcccctatgcagagacattccataagtggaccaatctcaacatccaaacccctgacagccctgtcagataagagaccaaactatggggaaatccctgttcaagagcatctgttaagaacatcttcagccagccggcctgcttccctgccaagagtgcctgcgatggaaagtgccaagaccctctcagtgtctcgacgaagtagtgaagaaatgaaacgggacatttctgcacaggagggagcgtcgccagcctctctgatggctatgggaaccacgtctccacagctttccctgtcctcttctccaacggcatctgtgactcccaccacccgaagccgaataagagaagaaaggaaagaccctctctcagcattggccagagaatatggaggatcaaagaggaacgccttgctgaagtggtgtcagaagaaaacagaaggctatcagaatattgacattacaaacttcagcagcagctggaatgatgggctggccttctgtgccctcctgcatacatatctccctgcccacattccatatcaagaactgaacagccaggataagagaaggaacttcatgctggctttccaggcagctgaaagtgtcggcatcaaatccacactggacattaatgaaatggtacggactgaacgacccgactggcagaacgtgatgctgtatgtgacggcgatctacaagtactttgagacctgagcatgccgggaggagccgccccaatagcgggggtacccctccacagcgaccgagcgacaccgacgccattagctacgcacccctgtaaagcttccagcaactctgggctgccccacagcgtgtgagcctccagctcggggcttccgtattggaagaactcagccgtgtggcccacagctcccaccagggcccctcccacatgacccgtccattcaggtcatgtgggctcagcacacatcctgcaggccggtggctgctggagttttccttctgaagagaatattgaactacactagtgctccagggcaccaaacaaaaagggctcatgcacagctgaatttgggaaaagggattcagttctgtgggaaactcactagggttgatgaaggctcggccgcggcacttcctgactattggctggggtgggttccggtgctggtgagaacccagaaggagagtcagcgcctggcagttcccagcgccctgggcccttcaccgtcctagtttggaggagcatgttcaccacagacgtgggtcagctgccccacacctgacggggctgtcccggccgacacaatccaggcgtgttcagcctgagctaggagagtatctagagggcgtggtgcgggcacgccagggctggggtgctgctgctgcactcacgcggctgggctttctggcgggaagcagttacgggggccccttgcctggactcagcgacctgtcttccagcctggaaggggtttggagtcccagctctggctttagatttcttcatcataaggagtttttctagttaacatttttgttttgttacgagcaatgctggaaaaggtcgctcctgttctgttagtaccaaagttacattgtttcaataagcatagaaatctaaacaacatctgtacattagcatggtgagagcaaggaataaagcaggaaataggagaaaagtaaacaactttagggagcccaggcagtgtcatttaaactcactgagtcactaagacataattctcctaggccagagttaaagaaagtgccttaactcttcttgtgagggcagccactgccctccatggccaaggcaggacctccaagactcagtggttgagttgtctcctaccaccatgcccgccctccccaggtactgggtccatgccccctgtgcccaccctccccaggtgctgggtccatgctgtttgaaccaaagccttatttaaaggtggtcactggagatgctctcaggccagaactcaacagctatttttgggaatagggatctcccgtgtgcctaacgcagtagctattggtttgaacaatgtccagacaagacctgtacctttgagaatataactgtgtttggcacctgcatagcaccatgaggaagaccagccaccagtggaagcggggtcactgccccacagactggatgcaatgaggggctcacaggaggcccagccagcccgattgtgggctgaggggtctgcattcaagcacgatgttctagaataggagtttaacgtgtctacgtaacctagaatgtggttattaggaaaggggctgtgcatgtgggtgcagctggcggcacacctggtcaccagatggccagaagctgcccatcagccctgcccagatgtcagcctgggagctcaggctgctgccgctggctggatgccctttggtgaaatgcctgttttcagctaagaaaggagaggccaggcaagcaaagtcatgccacaaagcatatcagagacccccgcagactcctggccccgtcccgccccccgtctgagttgtgtttttgttgctgttcctctgttgatggccagctctgctgttggcatgagccactgatgttcatgtgagaattactgtttttaagtgtctctccacttaggtgtcctcagttcccacttttgctctcatttgccttcacagaggccactccacctgtccggatccagctgtctggtcatggtttggtttatttattttgtccttcaggggctgttttgccctaagaatgagggggcttcccctggtctgcagttcccaactttatcccttgctggccatgcgagcccagccctggtgcctcatgggatgggggggtaggggtccccaggatcttctggaggaaggtggccatggatggatgggctgtatctgtgttttccctctgggagtctcatgggtccagcatcaggcctgaggtcagcaacagggaaagagggtgggcacggggagggcttggccccgcctatctagaggcttgcctcgggcccctccttggggaaggtttgcgtgcagagctgcaagggagagggttccagaagcattgccttttgcctcgtctaataggatccttaggacactgtgggctttaggaatgactatagatgctcacacgtgtttaaagtgacatttggagatgctctcagtcctgtggcatctggcacgaagtctccaagaagccactttgcctcttctcccttcaagcacaagctttactgcaaaagggccagtcgcgtttctatttctctcgatcccaggcttctgcggaccgacgatacgtttaaatgttgttctagtaaatattcttgaatgtattaaaatggctgaaacaacaagcttgggcttttctagcttgccctccactccctgccgtccctctgacgtcgcataaaccagaacccagctccctcctgggactggctgtggagagaagggcacctctgagccagcctgtggccctaccccaaggcgcacttcctcatgtgggcagatcctgaccaggagtccagggtggcctcccctgggccacagcacatcaccgtgtggcctggggctgtgggacagtgagccctgtaaccactagggttctgtgacagatgccaagaccccagagaccgtggcagagctacccccaggagagcggaagcccctacacagcccagacacatgccttccctgggggctggggagtgtgtctcgaggggttttgtttgttttgaggcatgtatcatcttggaaataattgtcaggatgtataaaatagagaaaaagaaaaaaggtatcctacccagaggcaaccagataaacttttttgcctgtgcattgtt

SEQ ID NO: 419393 - DNA, 4482 bp, Homo sapiens
cttcccagtgggactccagcagggcgtcgtggtctgtgcggtgtctcccaaaccactacctggctgcccccgtaccagctgctgggaaagactacttcctccgagttgtgccggcctccgcgttctcctcacctcccctctcctccggacctccgccccctcgcggagaggccttgccgctttaagagccgggctagcgattgacaagcaataaacgctgagcgcccggctgcgctggagccgcccggagctaggggcttcccggggcgcaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggtgataatggtattgtggtttatgcagcagaatgtctttgttcctatgaaatacatgctgaaatactttggggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacgttcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcagcaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtccttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagccagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtgtgtgcgtgtgcacgtgcgtgtgtgtgtgtgtgtgtcaggtttagtttggggaggaagcaaagggttttgttttggaggtcactctttggggcccctttctgggggttccccatcagccctcatttcttataataccctgatcccagactccaaagccctggtcctttcctgatgtctcctcccttgtcttattgtccccctaccctaaatgcccccctgccataacttggggagggcagttttgtaaaataggagactccctttaagaaagaatgctgtcctagatgtacttgggcatctcatccttcattattctctgcattccttccggggggagcctgtcctcagaggggacaacctgtgacaccctgagtccaaacccttgtgcctcccagttcttccaagtgtctaactagtcttcgctgcagcgtcagccaaagctggcccctgaaccactgtgtgcccatttcctagggaaggggaaggagaataaacagaatatttattacaaaagttagaatatatttcttatactaggaatctcatttgcatttgcatagactatacacatggggtggaaaggccaggcctgcccccatctcgttggtgtggctctgcgtatactacacactcattctcctgctcctcttttcccttagtcagtgtcctttcatcctgattcagctctgccttgcatcaccctcagcctaagggagtgggaaggaaatggggtgttttcttgctgacctgaggctatagggtcacttgccatttcctaccttctctgggggatttgagggtagaggcaggggaagatctgttgttgcagttgcttctgcccccttgatccaaatgaccatcatctctgatggagatgggttgggtacctggccttcatggcaccttcactgctagggatgctcaaggggcaggcctggggcccttccctcctgtctcttctcggtctttcctctctgagcagcctcctacctcccctgcctgagccctcactccacagccctcccaggtacctagcagaggctgtcagtccttggctcacctggaacagggctggggctgggttggaacaggtgtgtgcccccaccacagctctatgactctgttctccctccctgccattgtggactcttgtatttgagggacctcaagagagtgaggaccctaccatccactgtccatattcagtcccagccccagtgcgcttcctctgttccctccctcagccatccaattcttgagttttctcactgattggttttctttctttttccttggattaaatgtgaaagcaaaggc

SEQ ID NO: 419394 - DNA, 2749 bp, Homo sapiens
aggctgtactgcctcggaatttcgggcaggtgggatccactgaggagtacataggctgctggatctggtggagccagcactgggcccacgggtggtaactggctgctgtggaggggggtacgtgagggggggggtctggggcttatcctcaggtcctgtgggtggggcagcgagtcggggcctgagcgtcaagagcatgccctagtgagcgggctcctctgggggagcccagcgcgctccgggcgcctgccggtttgggggtgtctcctcccggggcgctatggcggcgctggccagtagcctgatccggcagaagcgggaggtccgcgagcccgggggcagccggccggtgtcggcgcagcggcgcgtgtgtccccgcggcaccaagtccctttgccagaagcagctcctcatcctgctgtccaaggtgcgactgtgcggggggcggcccgcgcggccggaccgcggcccggagcctcagctcaaaggcatcgtcaccaaactgttctgccgccagggtttctacctccaggcgaatcccgacggaagcatccagggcaccccagaggataccagctccttcacccacttcaacctgatccctgtgggcctccgtgtggtcaccatccagagcgccaagctgggtcactacatggccatgaatgctgagggactgctctacagttcgccgcatttcacagctgagtgtcgctttaaggagtgtgtctttgagaattactacgtcctgtacgcctctgctctctaccgccagcgtcgttctggccgggcctggtacctcggcctggacaaggagggccaggtcatgaagggaaaccgagttaagaagaccaaggcagctgcccactttctgcccaagctcctggaggtggccatgtaccaggagccttctctccacagtgtccccgaggcctccccttccagtccccctgccccctgaaatgtagtccctggactggaggttccctgcactcccagtgagccagccaccaccacaacctgtctcccagtcctgctctcacccctgctgccacacacatgccctgagcagccaggtcccactaggtgctctaccctgagggagcctaggggctgactgtgacttccgaggctgctgagacccttagatctttgggcctaggagggagtcagagagggggatgtctgaagatggtcctggctgatcacttctttctttccacactcacacaaccccatgccttttcctgagatggcgctgggagttcccacatggacagccagggcataaacacttcccaccccggctcagccagttcctggagtcctgtgccccttttcattgccactgagccatttctagattcactggagctcaggattcatgtgtccttctttccctactctaccttctaccttggtctggacacattctggaacactggacaccctcgccagggccacttctgcactagggctctgtgctggaacccaggcatgctgccagccttttctctggatctgtcaggcctctgtccttgactcagatggacccctggtttccaagtagaaagaggctagatttgggccttgtctagctgttggctttggcctgaaccggaaccagtctcagatgaccacgggtttaaccttcttatcccagagacacccaattctagagctttatggagccgtacttccccctgaatcctagctctaggacatagatcatgactctcagcccttttacccaggatggagctggggcctgtatagccatattattgttctaagtaagttctagccccaccctcccgccttcttgagtgatacctattacggatgagttctggaaaagacccagctatgattcataaaaacacttctggatgaatcaagaaccatttcttgtttttcctagataattctctaaaaatatgattcttccatatagaatgctaagcttatttttacatgcagtttctagctccttcaacccagctgaggtcgtgccagggagacagagtctggagaagggcagaggaattttggaaggatccctggctcatagtagggaagctgggatgggggaggggtcaaaattatggcatgactgaacctgcatctgtgttgggtggacatgaatacttagctacctcagcaggaattccttccaggtcccctttaaagctgaggtccttagagtaatatgtccttaataaaaaggacaaatggatacagccttgaccctcccagtgaggagaccccaattcagcaataagtctcacccttctcccctacaggtcaggccaagaagggtgaaggcctcttgcactccagacctcatacgccccaacagcttctaattggatagaacttgctttaccttacagctcacaacctcagctgggttttaggtacccaaaaagggcctgtctagattttttcagaaaaacgtggagtgctaggggcagcctggaaaagatggggaacctgctagtgaactaggagggagacttccatagcctcagacttggatagggtaggctgagggggccctaagggagggactaaggctccaaggcaggtcacttttccttaggctgttctacttctggcttgttgcaagaggagtagatgccccctcacccacacaaaccccactcagtctccacccaactcctggcactgctcccaggggatcgggtctccactccagctttctcaattaaagacgatttatacaactgaa

SEQ ID NO: 419395 - DNA, 4248 bp, Homo sapiens
tcccgccttccccagcccggaggctttggctggggaggcggtagacggcggcgtgtaggacgctccgggagtccccgggtctgggggccgccatggcaggcagcccaggcagcggggtctccttggagggtatatccctggagtcttctgaggaagcggagctccagagggaagccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacgttcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcagcaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtccttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagccagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtgtgtgcgtgtgcacgtgcgtgtgtgtgtgtgtgtgtcaggtttagtttggggaggaagcaaagggttttgttttggaggtcactctttggggcccctttctgggggttccccatcagccctcatttcttataataccctgatcccagactccaaagccctggtcctttcctgatgtctcctcccttgtcttattgtccccctaccctaaatgcccccctgccataacttggggagggcagttttgtaaaataggagactccctttaagaaagaatgctgtcctagatgtacttgggcatctcatccttcattattctctgcattccttccggggggagcctgtcctcagaggggacaacctgtgacaccctgagtccaaacccttgtgcctcccagttcttccaagtgtctaactagtcttcgctgcagcgtcagccaaagctggcccctgaaccactgtgtgcccatttcctagggaaggggaaggagaataaacagaatatttattacaaaagttagaatatatttcttatactaggaatctcatttgcatttgcatagactatacacatggggtggaaaggccaggcctgcccccatctcgttggtgtggctctgcgtatactacacactcattctcctgctcctcttttcccttagtcagtgtcctttcatcctgattcagctctgccttgcatcaccctcagcctaagggagtgggaaggaaatggggtgttttcttgctgacctgaggctatagggtcacttgccatttcctaccttctctgggggatttgagggtagaggcaggggaagatctgttgttgcagttgcttctgcccccttgatccaaatgaccatcatctctgatggagatgggttgggtacctggccttcatggcaccttcactgctagggatgctcaaggggcaggcctggggcccttccctcctgtctcttctcggtctttcctctctgagcagcctcctacctcccctgcctgagccctcactccacagccctcccaggtacctagcagaggctgtcagtccttggctcacctggaacagggctggggctgggttggaacaggtgtgtgcccccaccacagctctatgactctgttctccctccctgccattgtggactcttgtatttgagggacctcaagagagtgaggaccctaccatccactgtccatattcagtcccagccccagtgcgcttcctctgttccctccctcagccatccaattcttgagttttctcactgattggttttctttctttttccttggattaaatgtgaaagcaaaggc

SEQ ID NO: 419396 - DNA, 4355 bp, Homo sapiens
gcgacctggtgccactcctcagggaatgtctgagtggaggctgcagtaccctgatggtggcctcttgggcacaagatctcagaggaatggggtcaccggagcggagctgagtccttcccttctgcccacacttttccctgtgtgcaaatgtgccctcatttttcctttctggggaactgagttccaagatgcctgacttgcttcctgggcatcatccccttcattaagaggaagaactcatgggagatgggggaggggaagaagctgctgtgaggcgagggccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacgttcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcagcaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtccttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagccagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtgtgtgcgtgtgcacgtgcgtgtgtgtgtgtgtgtgtcaggtttagtttggggaggaagcaaagggttttgttttggaggtcactctttggggcccctttctgggggttccccatcagccctcatttcttataataccctgatcccagactccaaagccctggtcctttcctgatgtctcctcccttgtcttattgtccccctaccctaaatgcccccctgccataacttggggagggcagttttgtaaaataggagactccctttaagaaagaatgctgtcctagatgtacttgggcatctcatccttcattattctctgcattccttccggggggagcctgtcctcagaggggacaacctgtgacaccctgagtccaaacccttgtgcctcccagttcttccaagtgtctaactagtcttcgctgcagcgtcagccaaagctggcccctgaaccactgtgtgcccatttcctagggaaggggaaggagaataaacagaatatttattacaaaagttagaatatatttcttatactaggaatctcatttgcatttgcatagactatacacatggggtggaaaggccaggcctgcccccatctcgttggtgtggctctgcgtatactacacactcattctcctgctcctcttttcccttagtcagtgtcctttcatcctgattcagctctgccttgcatcaccctcagcctaagggagtgggaaggaaatggggtgttttcttgctgacctgaggctatagggtcacttgccatttcctaccttctctgggggatttgagggtagaggcaggggaagatctgttgttgcagttgcttctgcccccttgatccaaatgaccatcatctctgatggagatgggttgggtacctggccttcatggcaccttcactgctagggatgctcaaggggcaggcctggggcccttccctcctgtctcttctcggtctttcctctctgagcagcctcctacctcccctgcctgagccctcactccacagccctcccaggtacctagcagaggctgtcagtccttggctcacctggaacagggctggggctgggttggaacaggtgtgtgcccccaccacagctctatgactctgttctccctccctgccattgtggactcttgtatttgagggacctcaagagagtgaggaccctaccatccactgtccatattcagtcccagccccagtgcgcttcctctgttccctccctcagccatccaattcttgagttttctcactgattggttttctttctttttccttggattaaatgtgaaagcaaaggc

SEQ ID NO: 419397 - DNA, 4182 bp, Homo sapiens
cgctgccgccgctctgcctggtccagccaccggcccagtgctctgacttcgccggaccggggagctctgcagagacaccctcactccttcccgagggtccgggacgcctagccgggcgtggggggaagctccgtttgcgggggacagggagggaggagcctggagccgaagccagcgccacccgtcgccggatcaacaggacaggacaggttgaggggcgtcgggaaaaggaagagggggtgctataggcaatcccggggaggacgaggaagccctgtagcaggaagctgtgatccgctctgacttgtagggggcctgttcacatctggggactggtgacaacgtgggtgcactcctctcttggggggctggttagattggagggcgtgggatctaaacagcaccagctgtccccaagaaaatttaaggggcagccaggggagaaaaaaacaaaaacaaaaacaaacacggatgctcctcattttgaggtggcggaaggccctccagtcaactacctggtgtatccactaggaagggtggatttggaggtgacttcaaaaggagcggagggtgtgaaggtgaagaaagggtcttggccgctagaattctatgctactagacatgggggggacttggtgaaaaaggtattatccagccagagggtctgggagccctgtcttactgaacctgggcaacctggatattctgagacatattttggggggatttcagtgaaaaaagtgggggatcccctccatttagagtgtagcaaaggaaaaaacaccaaggttgggttccttcctgacattggcagtgccccagtaggggtgggatgagcgaatattcccaaagctaaagtcccacaccctgtagattacaagagtggatttggcaggagtgtgccccaaaatacagtggaaaggtgcctgaagatatttaaaccacgtcttggaaatttagtgggtcttggctttgggataggtgaagtgaggacagacactggagaggagggaaaggggacgttttcaataggaggcaaaactcgagggtgggatccactgaggagtacataggctgctggatctggtggagccagcactgggcccacgggtggtaactggctgctgtggaggggggtacgtgagggggggggtctggggcttatcctcaggtcctgtgggtggggcagcgagtcggggcctgagcgtcaagagcatgccctagtgagcgggctcctctgggggagcccagcgcgctccgggcgcctgccggtttgggggtgtctcctcccggggcgctatggcggcgctggccagtagcctgatccggcagaagcgggaggtccgcgagcccgggggcagccggccggtgtcggcgcagcggcgcgtgtgtccccgcggcaccaagtccctttgccagaagcagctcctcatcctgctgtccaaggtgcgactgtgcggggggcggcccgcgcggccggaccgcggcccggagcctcagctcaaaggcatcgtcaccaaactgttctgccgccagggtttctacctccaggcgaatcccgacggaagcatccagggcaccccagaggataccagctccttcacccacttcaacctgatccctgtgggcctccgtgtggtcaccatccagagcgccaagctgggtcactacatggccatgaatgctgagggactgctctacagttcgccgcatttcacagctgagtgtcgctttaaggagtgtgtctttgagaattactacgtcctgtacgcctctgctctctaccgccagcgtcgttctggccgggcctggtacctcggcctggacaaggagggccaggtcatgaagggaaaccgagttaagaagaccaaggcagctgcccactttctgcccaagctcctggaggtggccatgtaccaggagccttctctccacagtgtccccgaggcctccccttccagtccccctgccccctgaaatgtagtccctggactggaggttccctgcactcccagtgagccagccaccaccacaacctgtctcccagtcctgctctcacccctgctgccacacacatgccctgagcagccaggtcccactaggtgctctaccctgagggagcctaggggctgactgtgacttccgaggctgctgagacccttagatctttgggcctaggagggagtcagagagggggatgtctgaagatggtcctggctgatcacttctttctttccacactcacacaaccccatgccttttcctgagatggcgctgggagttcccacatggacagccagggcataaacacttcccaccccggctcagccagttcctggagtcctgtgccccttttcattgccactgagccatttctagattcactggagctcaggattcatgtgtccttctttccctactctaccttctaccttggtctggacacattctggaacactggacaccctcgccagggccacttctgcactagggctctgtgctggaacccaggcatgctgccagccttttctctggatctgtcaggcctctgtccttgactcagatggacccctggtttccaagtagaaagaggctagatttgggccttgtctagctgttggctttggcctgaaccggaaccagtctcagatgaccacgggtttaaccttcttatcccagagacacccaattctagagctttatggagccgtacttccccctgaatcctagctctaggacatagatcatgactctcagcccttttacccaggatggagctggggcctgtatagccatattattgttctaagtaagttctagccccaccctcccgccttcttgagtgatacctattacggatgagttctggaaaagacccagctatgattcataaaaacacttctggatgaatcaagaaccatttcttgtttttcctagataattctctaaaaatatgattcttccatatagaatgctaagcttatttttacatgcagtttctagctccttcaacccagctgaggtcgtgccagggagacagagtctggagaagggcagaggaattttggaaggatccctggctcatagtagggaagctgggatgggggaggggtcaaaattatggcatgactgaacctgcatctgtgttgggtggacatgaatacttagctacctcagcaggaattccttccaggtcccctttaaagctgaggtccttagagtaatatgtccttaataaaaaggacaaatggatacagccttgaccctcccagtgaggagaccccaattcagcaataagtctcacccttctcccctacaggtcaggccaagaagggtgaaggcctcttgcactccagacctcatacgccccaacagcttctaattggatagaacttgctttaccttacagctcacaacctcagctgggttttaggtacccaaaaagggcctgtctagattttttcagaaaaacgtggagtgctaggggcagcctggaaaagatggggaacctgctagtgaactaggagggagacttccatagcctcagacttggatagggtaggctgagggggccctaagggagggactaaggctccaaggcaggtcacttttccttaggctgttctacttctggcttgttgcaagaggagtagatgccccctcacccacacaaaccccactcagtctccacccaactcctggcactgctcccaggggatcgggtctccactccagctttctcaattaaagacgatttatacaactgaaaaaaaaaaaaaaaaaaaaaaaaaaaaagaaaaaaaaaaaaaaaagggggggggggcggccaaaaaaaaaaccccgaggagggggccacccgctaagcggggcccccgagagtgtgtgtggtaacaaaggggggccccccaagaaggaggggccgcgtataaaaagagcaaagcacacgcaggacccgcgataaacaacaggcggggcggcggcaaacaacatggcatgctcggggacatcagggggggaagaggaaaccaaccactgtgggggggggcgcgacacgtggggcaacaacacccacagaagagttgtaggccgcaaaggaacactaaaacgtgcggggtacatgtggtaacccacacgcggatatgctgacggcgagaatggcacacggtgatagagaaaatatcg

SEQ ID NO: 419398 - DNA, 2445 bp, Homo sapiens
cgctgccgccgctctgcctggtccagccaccggcccagtgctctgacttcgccggaccggggagctctgcagagacaccctcactccttcccgagggtccgggacgcctagccgggcgtggggggaagctccgtttgcgggggacagggagggaggagcctggagccgaagccagcgccacccgtcgccggatcaacaggacaggacagagcctcagctcaaaggcatcgtcaccaaactgttctgccgccagggtttctacctccaggcgaatcccgacggaagcatccagggcaccccagaggataccagctccttcacccacttcaacctgatccctgtgggcctccgtgtggtcaccatccagagcgccaagctgggtcactacatggccatgaatgctgagggactgctctacagttcggtcctacatggactcagaagttgtcctccccctcccccaaaaagcgtcgttctggccgggcctggtacctcggcctggacaaggagggccaggtcatgaagggaaaccgagttaagaagaccaaggcagctgcccactttctgcccaagctcctggaggtggccatgtaccaggagccttctctccacagtgtccccgaggcctccccttccagtccccctgccccctgaaatgtagtccctggactggaggttccctgcactcccagtgagccagccaccaccacaacctgtctcccagtcctgctctcacccctgctgccacacacatgccctgagcagccaggtcccactaggtgctctaccctgagggagcctaggggctgactgtgacttccgaggctgctgagacccttagatctttgggcctaggagggagtcagagagggggatgtctgaagatggtcctggctgatcacttctttctttccacactcacacaaccccatgccttttcctgagatggcgctgggagttcccacatggacagccagggcataaacacttcccaccccggctcagccagttcctggagtcctgtgccccttttcattgccactgagccatttctagattcactggagctcaggattcatgtgtccttctttccctactctaccttctaccttggtctggacacattctggaacactggacaccctcgccagggccacttctgcactagggctctgtgctggaacccaggcatgctgccagccttttctctggatctgtcaggcctctgtccttgactcagatggacccctggtttccaagtagaaagaggctagatttgggccttgtctagctgttggctttggcctgaaccggaaccagtctcagatgaccacgggtttaaccttcttatcccagagacacccaattctagagctttatggagccgtacttccccctgaatcctagctctaggacatagatcatgactctcagcccttttacccaggatggagctggggcctgtatagccatattattgttctaagtaagttctagccccaccctcccgccttcttgagtgatacctattacggatgagttctggaaaagacccagctatgattcataaaaacacttctggatgaatcaagaaccatttcttgtttttcctagataattctctaaaaatatgattcttccatatagaatgctaagcttatttttacatgcagtttctagctccttcaacccagctgaggtcgtgccagggagacagagtctggagaagggcagaggaattttggaaggatccctggctcatagtagggaagctgggatgggggaggggtcaaaattatggcatgactgaacctgcatctgtgttgggtggacatgaatacttagctacctcagcaggaattccttccaggtcccctttaaagctgaggtccttagagtaatatgtccttaataaaaaggacaaatggatacagccttgaccctcccagtgaggagaccccaattcagcaataagtctcacccttctcccctacaggtcaggccaagaagggtgaaggcctcttgcactccagacctcatacgccccaacagcttctaattggatagaacttgctttaccttacagctcacaacctcagctgggttttaggtacccaaaaagggcctgtctagattttttcagaaaaacgtggagtgctaggggcagcctggaaaagatggggaacctgctagtgaactaggagggagacttccatagcctcagacttggatagggtaggctgagggggccctaagggagggactaaggctccaaggcaggtcacttttccttaggctgttctacttctggcttgttgcaagaggagtagatgccccctcacccacacaaaccccactcagtctccacccaactcctggcactgctcccaggggatcgggtctccactccagctttctcaattaaagacgatttatacaactgaa

SEQ ID NO: 419399 - DNA, 3314 bp, Homo sapiens
cttcccagtgggactccagcagggcgtcgtggtctgtgcggtgtctcccaaaccactacctggctgcccccgtaccagctgctgggaaagactacttcctccgagttgtgccggcctccgcgttctcctcacctcccctctcctccggacctccgccccctcgcggagaggccttgccgctttaagagccgggctagcgattgacaagcaataaacgctgagcgcccggctgcgctggagccgcccggagctaggggcttcccggggcgcaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacgttcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcagcaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtccttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagccagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtgtgcccccaccacagctctatgactctgttctccctccctgccattgtggactcttgtatttgagggacctcaagagagtgaggaccctaccatccactgtccatattcagtcccagccccagtgcgcttcctctgttccctccctcagccatccaattcttgagttttctcactgattggttttctttctttttccttggattaaatgtgaaagcaaaggc

SEQ ID NO: 419400 - DNA, 4410 bp, Homo sapiens
cttcccagtgggactccagcagggcgtcgtggtctgtgcggtgtctcccaaaccactacctggctgcccccgtaccagctgctgggaaagactacttcctccgagttgtgccggcctccgcgttctcctcacctcccctctcctccggacctccgccccctcgcggagaggccttgccgctttaagagccgggctagcgattgacaagcaataaacgctgagcgcccggctgcgctggagccgcccggagctaggggcttcccggggcgcaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacgttcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcagcaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtccttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagccagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtgtgtgcgtgtgcacgtgcgtgtgtgtgtgtgtgtgtcaggtttagtttggggaggaagcaaagggttttgttttggaggtcactctttggggcccctttctgggggttccccatcagccctcatttcttataataccctgatcccagactccaaagccctggtcctttcctgatgtctcctcccttgtcttattgtccccctaccctaaatgcccccctgccataacttggggagggcagttttgtaaaataggagactccctttaagaaagaatgctgtcctagatgtacttgggcatctcatccttcattattctctgcattccttccggggggagcctgtcctcagaggggacaacctgtgacaccctgagtccaaacccttgtgcctcccagttcttccaagtgtctaactagtcttcgctgcagcgtcagccaaagctggcccctgaaccactgtgtgcccatttcctagggaaggggaaggagaataaacagaatatttattacaaaagttagaatatatttcttatactaggaatctcatttgcatttgcatagactatacacatggggtggaaaggccaggcctgcccccatctcgttggtgtggctctgcgtatactacacactcattctcctgctcctcttttcccttagtcagtgtcctttcatcctgattcagctctgccttgcatcaccctcagcctaagggagtgggaaggaaatggggtgttttcttgctgacctgaggctatagggtcacttgccatttcctaccttctctgggggatttgagggtagaggcaggggaagatctgttgttgcagttgcttctgcccccttgatccaaatgaccatcatctctgatggagatgggttgggtacctggccttcatggcaccttcactgctagggatgctcaaggggcaggcctggggcccttccctcctgtctcttctcggtctttcctctctgagcagcctcctacctcccctgcctgagccctcactccacagccctcccaggtacctagcagaggctgtcagtccttggctcacctggaacagggctggggctgggttggaacaggtgtgtgcccccaccacagctctatgactctgttctccctccctgccattgtggactcttgtatttgagggacctcaagagagtgaggaccctaccatccactgtccatattcagtcccagccccagtgcgcttcctctgttccctccctcagccatccaattcttgagttttctcactgattggttttctttctttttccttggattaaatgtgaaagcaaaggc

SEQ ID NO: 419401 - DNA, 3768 bp, Homo sapiens
cgctgccgccgctctgcctggtccagccaccggcccagtgctctgacttcgccggaccggggagctctgcagagacaccctcactccttcccgagggtccgggacgcctagccgggcgtggggggaagctccgtttgcgggggacagggagggaggagcctggagccgaagccagcgccacccgtcgccggatcaacaggacaggacaggttgaggggcgtcgggaaaaggaagagggggtgctataggcaatcccggggaggacgaggaagccctgtagcaggaagctgtgatccgctctgacttgtagggggcctgttcacatctggggactggtgacaacgtgggtgcactcctctcttggggggctggttagattggagggcgtgggatctaaacagcaccagctgtccccaagaaaatttaaggggcagccaggggagaaaaaaacaaaaacaaaaacaaacacggatgctcctcattttgaggtggcggaaggccctccagtcaactacctggtgtatccactaggaagggtggatttggaggtgacttcaaaaggagcggagggtgtgaaggtgaagaaagggtcttggccgctagaattctatgctactagacatgggggggacttggtgaaaaaggtattatccagccagagggtctgggagccctgtcttactgaacctgggcaacctggatattctgagacatattttggggggatttcagtgaaaaaagtgggggatcccctccatttagagtgtagcaaaggaaaaaacaccaaggttgggttccttcctgacattggcagtgccccagtaggggtgggatgagcgaatattcccaaagctaaagtcccacaccctgtagattacaagagtggatttggcaggagtgtgccccaaaatacagtggaaaggtgcctgaagatatttaaaccacgtcttggaaatttagtgggtcttggctttgggataggtgaagtgaggacagacactggagaggagggaaaggggacgttttcaataggaggcaaaactcgagggtgggatccactgaggagtacataggctgctggatctggtggagccagcactgggcccacgggtggtaactggctgctgtggaggggggtacgtgagggggggggtctggggcttatcctcaggtcctgtgggtggggcagcgagtcggggcctgagcgtcaagagcatgccctagtgagcgggctcctctgggggagcccagcgcgctccgggcgcctgccggtttgggggtgtctcctcccggggcgctatggcggcgctggccagtagcctgatccggcagaagcgggaggtccgcgagcccgggggcagccggccggtgtcggcgcagcggcgcgtgtgtccccgcggcaccaagtccctttgccagaagcagctcctcatcctgctgtccaaggtgcgactgtgcggggggcggcccgcgcggccggaccgcggcccggagcctcagctcaaaggcatcgtcaccaaactgttctgccgccagggtttctacctccaggcgaatcccgacggaagcatccagggcaccccagaggataccagctccttcacccacttcaacctgatccctgtgggcctccgtgtggtcaccatccagagcgccaagctgggtcactacatggccatgaatgctgagggactgctctacagttcgccgcatttcacagctgagtgtcgctttaaggagtgtgtctttgagaattactacgtcctgtacgcctctgctctctaccgccagcgtcgttctggccgggcctggtacctcggcctggacaaggagggccaggtcatgaagggaaaccgagttaagaagaccaaggcagctgcccactttctgcccaagctcctggaggtggccatgtaccaggagccttctctccacagtgtccccgaggcctccccttccagtccccctgccccctgaaatgtagtccctggactggaggttccctgcactcccagtgagccagccaccaccacaacctgtctcccagtcctgctctcacccctgctgccacacacatgccctgagcagccaggtcccactaggtgctctaccctgagggagcctaggggctgactgtgacttccgaggctgctgagacccttagatctttgggcctaggagggagtcagagagggggatgtctgaagatggtcctggctgatcacttctttctttccacactcacacaaccccatgccttttcctgagatggcgctgggagttcccacatggacagccagggcataaacacttcccaccccggctcagccagttcctggagtcctgtgccccttttcattgccactgagccatttctagattcactggagctcaggattcatgtgtccttctttccctactctaccttctaccttggtctggacacattctggaacactggacaccctcgccagggccacttctgcactagggctctgtgctggaacccaggcatgctgccagccttttctctggatctgtcaggcctctgtccttgactcagatggacccctggtttccaagtagaaagaggctagatttgggccttgtctagctgttggctttggcctgaaccggaaccagtctcagatgaccacgggtttaaccttcttatcccagagacacccaattctagagctttatggagccgtacttccccctgaatcctagctctaggacatagatcatgactctcagcccttttacccaggatggagctggggcctgtatagccatattattgttctaagtaagttctagccccaccctcccgccttcttgagtgatacctattacggatgagttctggaaaagacccagctatgattcataaaaacacttctggatgaatcaagaaccatttcttgtttttcctagataattctctaaaaatatgattcttccatatagaatgctaagcttatttttacatgcagtttctagctccttcaacccagctgaggtcgtgccagggagacagagtctggagaagggcagaggaattttggaaggatccctggctcatagtagggaagctgggatgggggaggggtcaaaattatggcatgactgaacctgcatctgtgttgggtggacatgaatacttagctacctcagcaggaattccttccaggtcccctttaaagctgaggtccttagagtaatatgtccttaataaaaaggacaaatggatacagccttgaccctcccagtgaggagaccccaattcagcaataagtctcacccttctcccctacaggtcaggccaagaagggtgaaggcctcttgcactccagacctcatacgccccaacagcttctaattggatagaacttgctttaccttacagctcacaacctcagctgggttttaggtacccaaaaagggcctgtctagattttttcagaaaaacgtggagtgctaggggcagcctggaaaagatggggaacctgctagtgaactaggagggagacttccatagcctcagacttggatagggtaggctgagggggccctaagggagggactaaggctccaaggcaggtcacttttccttaggctgttctacttctggcttgttgcaagaggagtagatgccccctcacccacacaaaccccactcagtctccacccaactcctggcactgctcccaggggatcgggtctccactccagctttctcaattaaagacgatttatacaactgaa

SEQ ID NO: 419402 - DNA, 5887 bp, Homo sapiens
  misc_feature (1748)..(1748): n is a, c, g, or t
cgctgccgccgctctgcctggtccagccaccggcccagtgctctgacttcgccggaccggggagctctgcagagacaccctcactccttcccgagggtccgggacgcctagccgggcgtggggggaagctccgtttgcgggggacagggagggaggagcctggagccgaagccagcgccacccgtcgccggatcaacaggacaggacaggttgaggggcgtcgggaaaaggaagagggggtgctataggcaatcccggggaggacgaggaagccctgtagcaggaagctgtgatccgctctgacttgtagggggcctgttcacatctggggactggtgacaacgtgggtgcactcctctcttggggggctggttagattggagggcgtgggatctaaacagcaccagctgtccccaagaaaatttaaggggcagccaggggagaaaaaaacaaaaacaaaaacaaacacggatgctcctcattttgaggtggcggaaggccctccagtcaactacctggtgtatccactaggaagggtggatttggaggtgacttcaaaaggagcggagggtgtgaaggtgaagaaagggtcttggccgctagaattctatgctactagacatgggggggacttggtgaaaaaggtattatccagccagagggtctgggagccctgtcttactgaacctgggcaacctggatattctgagacatattttggggggatttcagtgaaaaaagtgggggatcccctccatttagagtgtagcaaaggaaaaaacaccaaggttgggttccttcctgacattggcagtgccccagtaggggtgggatgagcgaatattcccaaagctaaagtcccacaccctgtagattacaagagtggatttggcaggagtgtgccccaaaatacagtggaaaggtgcctgaagatatttaaaccacgtcttggaaatttagtgggtcttggctttgggataggtgaagtgaggacagacactggagaggagggaaaggggacgttttcaataggaggcaaaactcgagggtgggatccactgaggagtacataggctgctggatctggtggagccagcactgggcccacgggtggtaactggctgctgtggaggggggtacgtgagggggggggtctggggcttatcctcaggtcctgtgggtggggcagcgagtcggggcctgagcgtcaagagcatgccctagtgagcgggctcctctgggggagcccagcgcgctccgggcgcctgccggtttgggggtgtctcctcccggggcgctatggcggcgctggccagtagcctgatccggcagaagcgggaggtccgcgagcccgggggcagccggccggtgtcggcgcagcggcgcgtgtgtccccgcggcaccaagtccctttgccagaagcagctcctcatcctgctgtccaaggtgcgactgtgcggggggcggcccgcgcggccggaccgcggcccggagcctcagctcaaaggcatcgtcaccaaactgttctgccgccagggtttctacctccaggcgaatcccgacggaagcatccagggcaccccagaggataccagctccttcacccacttcaacctgatccctgtgggcctccgtgtggtcaccatccagagcgccaagctgggtcactacatggccatgaatgctgagggactgctctacagttcgacctggagatctccaggtctgaaatgctgggtcgacccagnagagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacgttcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcagcaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtccttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagccagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtgtgtgcgtgtgcacgtgcgtgtgtgtgtgtgtgtgtcaggtttagtttggggaggaagcaaagggttttgttttggaggtcactctttggggcccctttctgggggttccccatcagccctcatttcttataataccctgatcccagactccaaagccctggtcctttcctgatgtctcctcccttgtcttattgtccccctaccctaaatgcccccctgccataacttggggagggcagttttgtaaaataggagactccctttaagaaagaatgctgtcctagatgtacttgggcatctcatccttcattattctctgcattccttccggggggagcctgtcctcagaggggacaacctgtgacaccctgagtccaaacccttgtgcctcccagttcttccaagtgtctaactagtcttcgctgcagcgtcagccaaagctggcccctgaaccactgtgtgcccatttcctagggaaggggaaggagaataaacagaatatttattacaaaagttagaatatatttcttatactaggaatctcatttgcatttgcatagactatacacatggggtggaaaggccaggcctgcccccatctcgttggtgtggctctgcgtatactacacactcattctcctgctcctcttttcccttagtcagtgtcctttcatcctgattcagctctgccttgcatcaccctcagcctaagggagtgggaaggaaatggggtgttttcttgctgacctgaggctatagggtcacttgccatttcctaccttctctgggggatttgagggtagaggcaggggaagatctgttgttgcagttgcttctgcccccttgatccaaatgaccatcatctctgatggagatgggttgggtacctggccttcatggcaccttcactgctagggatgctcaaggggcaggcctggggcccttccctcctgtctcttctcggtctttcctctctgagcagcctcctacctcccctgcctgagccctcactccacagccctcccaggtacctagcagaggctgtcagtccttggctcacctggaacagggctggggctgggttggaacaggtgtgtgcccccaccacagctctatgactctgttctccctccctgccattgtggactcttgtatttgagggacctcaagagagtgaggaccctaccatccactgtccatattcagtcccagccccagtgcgcttcctctgttccctccctcagccatccaattcttgagttttctcactgattggttttctttctttttccttggattaaatgtgaaagcaaaggc

SEQ ID NO: 419403 - DNA, 2303 bp, Homo sapiens
cctcagctcccaccccccatatccttgagcctcagctcaaaggcatcgtcaccaaactgttctgccgccagggtttctacctccaggcgaatcccgacggaagcatccagggcaccccagaggataccagctccttcacccacttcaacctgatccctgtgggcctccgtgtggtcaccatccagagcgccaagctgggtcactacatggccatgaatgctgagggactgctctacagttcgccgcatttcacagctgagtgtcgctttaaggagtgtgtctttgagaattactacgtcctgtacgcctctgctctctaccgccagcgtcgttctggccgggcctggtacctcggcctggacaaggagggccaggtcatgaagggaaaccgagttaagaagaccaaggcagctgcccactttctgcccaagctcctggaggtggccatgtaccaggagccttctctccacagtgtccccgaggcctccccttccagtccccctgccccctgaaatgtagtccctggactggaggttccctgcactcccagtgagccagccaccaccacaacctgtctcccagtcctgctctcacccctgctgccacacacatgccctgagcagccaggtcccactaggtgctctaccctgagggagcctaggggctgactgtgacttccgaggctgctgagacccttagatctttgggcctaggagggagtcagagagggggatgtctgaagatggtcctggctgatcacttctttctttccacactcacacaaccccatgccttttcctgagatggcgctgggagttcccacatggacagccagggcataaacacttcccaccccggctcagccagttcctggagtcctgtgccccttttcattgccactgagccatttctagattcactggagctcaggattcatgtgtccttctttccctactctaccttctaccttggtctggacacattctggaacactggacaccctcgccagggccacttctgcactagggctctgtgctggaacccaggcatgctgccagccttttctctggatctgtcaggcctctgtccttgactcagatggacccctggtttccaagtagaaagaggctagatttgggccttgtctagctgttggctttggcctgaaccggaaccagtctcagatgaccacgggtttaaccttcttatcccagagacacccaattctagagctttatggagccgtacttccccctgaatcctagctctaggacatagatcatgactctcagcccttttacccaggatggagctggggcctgtatagccatattattgttctaagtaagttctagccccaccctcccgccttcttgagtgatacctattacggatgagttctggaaaagacccagctatgattcataaaaacacttctggatgaatcaagaaccatttcttgtttttcctagataattctctaaaaatatgattcttccatatagaatgctaagcttatttttacatgcagtttctagctccttcaacccagctgaggtcgtgccagggagacagagtctggagaagggcagaggaattttggaaggatccctggctcatagtagggaagctgggatgggggaggggtcaaaattatggcatgactgaacctgcatctgtgttgggtggacatgaatacttagctacctcagcaggaattccttccaggtcccctttaaagctgaggtccttagagtaatatgtccttaataaaaaggacaaatggatacagccttgaccctcccagtgaggagaccccaattcagcaataagtctcacccttctcccctacaggtcaggccaagaagggtgaaggcctcttgcactccagacctcatacgccccaacagcttctaattggatagaacttgctttaccttacagctcacaacctcagctgggttttaggtacccaaaaagggcctgtctagattttttcagaaaaacgtggagtgctaggggcagcctggaaaagatggggaacctgctagtgaactaggagggagacttccatagcctcagacttggatagggtaggctgagggggccctaagggagggactaaggctccaaggcaggtcacttttccttaggctgttctacttctggcttgttgcaagaggagtagatgccccctcacccacacaaaccccactcagtctccacccaactcctggcactgctcccaggggatcgggtctccactccagctttctcaattaaagacgatttatacaactgaa

SEQ ID NO: 419404 - DNA, 2777 bp, Homo sapiens
cgctgccgccgctctgcctggtccagccaccggcccagtgctctgacttcgccggaccggggagctctgcagagacaccctcactccttcccgagggtccgggacgcctagccgggcgtggggggaagctccgtttgcgggggacagggagggaggagcctggagccgaagccagcgccacccgtcgccggatcaacaggacaggacaggttgaggggcgtcgggaaaaggaagagggggtgctataggcaatcccggggaggacgaggaagccctgtagcaggaagctgtgatccgctctgacttgtagggggcctgttcacatctggggactggtgacaacgtgggtgcactcctctcttggggggctggttagattggagggcgtgggatctaaacagcaccagctgtccccaagaaaatttaaggggcagccaggggagaaaaaaacaaaaacaaaaacaaacacggatgctcctcattttgaggtggcggaaggccctccagtcaactacctggtgtatccactaggaagggtggatttggaggtgacttcaaaaggagcggagggtgtgaaggtgaagaaagggtcttggccgctagaattctatgctactagacatgggggggacttggtgaaaaaggtattatccagccagagggtctgggagccctgtcttactgaacctgggcaacctggatattctgagacatattttggggggatttcagtgaaaaaagtgggggatcccctccatttagagtgtagcaaaggaaaaaacaccaaggttgggttccttcctgacattggcagtgccccagtaggggtgggatgagcgaatattcccaaagctaaagtcccacaccctgtagattacaagagtggatttggcaggagtgtgccccaaaatacagtggaaaggtgcctgaagatatttaaaccacgtcttggaaatttagtgggtcttggctttgggataggtgaagtgaggacagacactggagaggagggaaaggggacgttttcaataggaggcaaaactcgagggtgggatccactgaggagtacataggctgctggatctggtggagccagcacaggtcccactaggtgctctaccctgagggagcctaggggctgactgtgacttccgaggctgctgagacccttagatctttgggcctaggagggagtcagagagggggatgtctgaagatggtcctggctgatcacttctttctttccacactcacacaaccccatgccttttcctgagatggcgctgggagttcccacatggacagccagggcataaacacttcccaccccggctcagccagttcctggagtcctgtgccccttttcattgccactgagccatttctagattcactggagctcaggattcatgtgtccttctttccctactctaccttctaccttggtctggacacattctggaacactggacaccctcgccagggccacttctgcactagggctctgtgctggaacccaggcatgctgccagccttttctctggatctgtcaggcctctgtccttgactcagatggacccctggtttccaagtagaaagaggctagatttgggccttgtctagctgttggctttggcctgaaccggaaccagtctcagatgaccacgggtttaaccttcttatcccagagacacccaattctagagctttatggagccgtacttccccctgaatcctagctctaggacatagatcatgactctcagcccttttacccaggatggagctggggcctgtatagccatattattgttctaagtaagttctagccccaccctcccgccttcttgagtgatacctattacggatgagttctggaaaagacccagctatgattcataaaaacacttctggatgaatcaagaaccatttcttgtttttcctagataattctctaaaaatatgattcttccatatagaatgctaagcttatttttacatgcagtttctagctccttcaacccagctgaggtcgtgccagggagacagagtctggagaagggcagaggaattttggaaggatccctggctcatagtagggaagctgggatgggggaggggtcaaaattatggcatgactgaacctgcatctgtgttgggtggacatgaatacttagctacctcagcaggaattccttccaggtcccctttaaagctgaggtccttagagtaatatgtccttaataaaaaggacaaatggatacagccttgaccctcccagtgaggagaccccaattcagcaataagtctcacccttctcccctacaggtcaggccaagaagggtgaaggcctcttgcactccagacctcatacgccccaacagcttctaattggatagaacttgctttaccttacagctcacaacctcagctgggttttaggtacccaaaaagggcctgtctagattttttcagaaaaacgtggagtgctaggggcagcctggaaaagatggggaacctgctagtgaactaggagggagacttccatagcctcagacttggatagggtaggctgagggggccctaagggagggactaaggctccaaggcaggtcacttttccttaggctgttctacttctggcttgttgcaagaggagtagatgccccctcacccacacaaaccccactcagtctccacccaactcctggcactgctcccaggggatcgggtctccactccagctttctcaattaaagacgatttatacaactgaa

SEQ ID NO: 419405 - DNA, 432 bp, Homo sapiens
ggcaaatataagtgagcaaataaatttgtgtggattatttagaaagtgtagatataaataattttcaactatgctttagaacactctcccactctgggaagaaaattttagaaaaaggataacccctgcatttctttccattagaagtacatgatcaaaagacaaagtccctttttcccttgactgtgacataacatgtccctcataggcaactgaacagataaaaaatccagacgatgcttagtaatttcctgcttcccctttagtgcacagtgtattatcagtatgttttgccctctttatttaatatcttgctgaattaaattatctcatcaggtttttaagcacaagcccagcctgctttctggatgacacctgccacaggtcatccttcctgaatttgcctaaatgaggggatcctctaggagacga

SEQ ID NO: 419406 - DNA, 431 bp, Homo sapiens
ggcaaatataagtgagcaaataaatttgtgtggattatttagaaagtgtagatataaataattttcaactatgctttagaacactctcccactctgggaagaaaattttagaaaaaggataacccctgcatttctttccattagaagtacatgatcaaaagacaaagtccctttttcccttgactgtgacataacatgtccctcataggcaactgaacagataaaaaatccagacgatgcttagtaatttcctgcttcccctttagtgcacagtgtattatcagtatgttttgccctctttatttaatatcttgctgaattaaattatctcatcaggtttttaagcacaagcccagcctgctttctggatgacacctgccacaggtcatccttcctgaatttgcctaaatagccccagaatattcttcaag

SEQ ID NO: 419407 - DNA, 463 bp, Homo sapiens
tcccaacttcagagaatcaactggctagcaccttggagcacctgctgtggtaacgtgagtggctgaacaccagacaaaaggaggctcccaatcactgttgcagatcttgttaaaatcctggctctatcctcagcttaggtgtattcttcttgtactaggataaagcctctctgacctcttcattaaggcctaagtatacagtatggtatatgacaagcaggaccttcctctcctccccctgtatcttcccaaactacaaaaacagaaagcccccaaccttctcacccctgcctcacacaaatccccacagtggactgtttaaaaaataacagtacttggtagatatatattctcacttgctttcattatagaaaaaagaaagaaaataaatgaactaaacatccaactcaaggaattacaaaaaggagaaagcctcctctgcccccaaggaaaaagttggaaa

SEQ ID NO: 419408 - DNA, 358 bp, Homo sapiens
agccccagaatattcttcaagcatgcccctggctcatcatcccaacttcagagaatcaactggctagcaccttggagcacctgctgtggtaacgtgagtggctgaacaccagacaaaaggaggctcccaatcactgttgcagatcttgttaaaatcctggctctatcctcagcttaggtgtattcttcttgtactaggataaagcctctctgacctcttcattaaggcctaagtatacagtatggtatatgacaagcaggaccttcctctcctccccctgtatcttcccaaactacaaaaacagaaagcccccaaccttctcacccctgcctcacacaaatccccacagtggactgtt

SEQ ID NO: 419409 - DNA, 475 bp, Homo sapiens
tgaaatgtatatccttccatagatatatataccttttgtagatacatacctttcatcttaaaggaattatgccttgtaaaagggtataattcctttaatatgaaaatcagattcaacttctgtgtgctttttaagggcaaatataagtgagcaaataaatttgtgtggattatttagaaagtgtagatataaataattttcaactatgctttagaacactctcccactctgggaagaaaattttagaaaaaggataacccctgcatttctttccattagaagtacatgatcaaaagacaaagtccctttttcccttgactgtgacataacatgtccctcataggcaactgaacagataaaaaatccagacgatgcttagtaatttcctgcttcccctttagtgcacagtgtattatcagtatgttttgccctctttatttaatatcttgctgaattaaattatctcatcaggttt

SEQ ID NO: 419410 - DNA, 1652 bp, Homo sapiens
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttga

SEQ ID NO: 419411 - DNA, 2658 bp, Homo sapiens
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttcatctaagatagtttctggaaatttcactctcgatctttctgtggacacaatctattttgtcattgtgtctatatgaatctcttaagtagaaatgagttgtatggtgaatctgtgtagtgataattatataatttatttattttgaatgcattatagtggctatttcagtttttcttaacatcatgcgacccctttcgcatgcactttacttatcctcctctgtcactcctatataatccct

SEQ ID NO: 419412 - DNA, 2364 bp, Homo sapiens
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttca

SEQ ID NO: 419413 - DNA, 2067 bp, Homo sapiens
  misc_feature (2039)..(2039): n is a, c, g, or t
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaacaaaaaaaaataaccaaaanaaagaaaatatccatagctaacaaaaaa

SEQ ID NO: 419414 - DNA, 2483 bp, Homo sapiens
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggacgcttgatgtaatgggcagaatcagaatgcttcaggaatctgtcgaatttgtttcttataatagcccctggaggaattgctacacccccagtgtatggtcagcttctagctttatatttgctccataatgacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttca

SEQ ID NO: 419415 - DNA, 2518 bp, Homo sapiens
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacataaacttttatgacctctatttacttaacttcatatataatcaataaaacaaaagaagtgaaaagagaagattgcagccaagaggaattcgttacaaacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttca

SEQ ID NO: 419416 - DNA, 1684 bp, Homo sapiens
tggtctggctgtacgcatgtgtgcaggtagagaagcaagacaacggatgatgctcaggtgtcggggaatcacagaaagcgtctttatgtgacaaaaaaggtagctagcttccagtgagagcaagccaccgtgactcaaaggccctgtgggaggaaagtatagctatactaccccgagtgatatggatcgacgtgtcttgagtttaatctatagctctcgtttattaccattaaatggtcgcaatcatatctggagcgagctatcatataccgaacttagctactcatgatcttgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttca

SEQ ID NO: 419417 - DNA, 2329 bp, Homo sapiens
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacatgaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttca

SEQ ID NO: 419418 - DNA, 2370 bp, Homo sapiens
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttca

SEQ ID NO: 419419 - DNA, 1111 bp, Homo sapiens
ggtaggtgttggggccaaagctttgttactgtggtatgtaacatgaagtgtgtttgtttctttaacatacagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttca

SEQ ID NO: 419420 - DNA, 2699 bp, Homo sapiens
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatttgaggaaatgggaattcaagaagtcagaggatcaggagagtgatcaagagaatgacagtgccagtttttttaacttccaggtattaagtacaaattgtatccatggttattttttaaaagcagattagagtcaatccaaatattcattaataggggattgtttgaataaacagcagtgtagactacgcaggtgtaaaaggagtgaagatctctatactaaactggaatgatctccagagtgagaacatagaaagcacatgtagtttatatggttattttgagggtaacaaaaggagaatgattacaattatatatatgtacatatttccttatatttcaaaactaagcaattgggggatatatacaaaatgaatataatagttccctaaagaggaaggagaggacagtgaactactacatagagaaaaaataatctcaagtgatcaaacacaatatttcaattttacattgtcagtgggatatacactaaggacagaaaaaaatcttagactaatgaatgtggtttttcatgattaatttcacaaaatcttgatatcttttttattattaaaagtatagattaaattaataatcatgtaacattagaccccagtaatcttaaatttgacatggaaacctcattatatgctttatttttctttgtaaacagtaaatatttcccactcctgtctacatgaaaaggtctagagtaattacagttcagtaacaatgagcaccactagtacccagatggtgttctttcattttcatttgcaattaaaaggaatcagaacttatttgcaaaacagctaatagttccagggcagtaagtgtacaagttcatatctggtacaagatgtccaggattcaaggaggctcttaaagacttgggattctgtcaaagggttatacaagccaacttgaagggatttctacaggccatgtaaaaatgagacagtttgagcatgaaatatttgtatatgtgtctgtttttaactcttaataacctcatcactgtacaagaaaggcagggtaagtgcttgatttcacttccctttattatcagttctcaggacaaattgatatgctgccaatctctaaagcaacaaaatcgaacctgtagggtagtcaaaaagctcatgctggaaaattccaccgaataaagataaaagttagaaa

SEQ ID NO: 419421 - DNA, 1483 bp, Homo sapiens
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacattgtaagtatgtttaacctaaagctaagagcaacaggtttctcaaagttatatggaaatatttctgcactgaagtagcaccactaaacataggcacaacgagctaccttttttattacagtaattgttaacgtctatttcctattgaatcataggttaatgaattatgattaggtcgtcattgtcttacatatactttctagaaaacatttcaatttattatgacaaattacgtcagtaaattcatttaacctttttgtctttttaagaaacttttatgacctctatttacttaacttcatatataatcaataaaacaaaagaagtgaaaagagaagattgcagccaagaggaattcgttacaaacatgtatgagattttttaagttttttttgtttttaattattcctatttcacgttcacatggaaaagtcagaaagcataactactctagcctgagcaaccaaagtgagaccctgtctcaaaaggaaagcataactgcaaaaa

SEQ ID NO: 419422 - DNA, 2418 bp, Homo sapiens
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttca

SEQ ID NO: 419423 - DNA, 1572 bp, Homo sapiens
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggtaaccctttgcgtcgcgctgggagaaactgcggagtagtcttaggccctggggcggcaccagtttccagggtaacggggtctgaggctagcgggctttgggagctcacggggcgggcgtgggaggtggacgtgtggatccctgaccgccgcaacctgctccgaccgggcccggtctccccgaactcgccgggacctttttgttatgtgtcttcagcttgtgagcccgaaaaccctgtgcgtctttgctccagcacctaccgatgagctcatattaattaggcatctttccttcccagtatcgggttgggagagggtagtaaagtgggttttattaaagatcttggtatacacacacacactaacacacacaccgcaactcacacgcacaccaagaaaaatgtgaccattgtaacctttttttaactcacaaagcctttctcgtaatgttgtcaagttagcttgccattttgtcttcagtaagacagatgaaagttatgcagctgttaaagttaatgtttttcttagacacttaaaaagggtttatatcattagttttaaaattaaataaaggagacaacatccagaagcagcagctcactaatagataatagatactttccagttgagttaaaatggaaagaattgtctttgcaacgcagctgt

SEQ ID NO: 419424 - DNA, 2604 bp, Homo sapiens
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttcatttgtcattgtgtctatatgaatctcttaagtagaaatgagttgtatggtgaatctgtgtagtgataattatataatttatttattttgaatgcattatagtggctatttcagtttttcttaacatcatgcgacccctttcgcatgcactttacttatcctcctctgtcactcctatataatccct

SEQ ID NO: 419425 - DNA, 2364 bp, Homo sapiens
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgtttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttca

SEQ ID NO: 419426 - DNA, 2436 bp, Homo sapiens
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacattgtggtggcgtaaattaggaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttca

SEQ ID NO: 419427 - DNA, 2785 bp, Homo sapiens
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacattgtaagtatgtttaacctaaagctaagagcaacaggtttctcaaagttatatggaaatatttctgcactgaagtagcaccactaaacataggcacaacgagctaccttttttattacagtaattgttaacgtctatttcctattgaatcataggttaatgaattatgattaggtcgtcattgtcttacatatactttctagaaaacatttcaatttattatgacaaattacgtcagtaaattcatttaacctttttgtctttttaagaaacttttatgacctctatttacttaacttcatatataatcaataaaacaaaagaagtgaaaagagaagattgcagccaagaggaattcgttacaaacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttca

SEQ ID NO: 419428 - DNA, 2378 bp, Homo sapiens
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacatgaataatgcaagatatctttggaaaagaataccacctgctataaaatctgaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttca

SEQ ID NO: 419429 - DNA, 1192 bp, Homo sapiens
actctagaggtatccctggcttcctacaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttca

SEQ ID NO: 419430 - DNA, 1739 bp, Homo sapiens
atataatgtcactaacagtaagtgctgtgctaaacaaaagccaggatggctacagcaagccggaggggagctgagaattagatgtaaattctgagggatgggaagggccctagattttagggcgttgtgcagaagagtaaccagatctgctctacgtttcaggaaaggaaaaaaaaattccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacattgtaagtatgtttaacctaaagctaagagcaacaggtttctcaaagttatatggaaatatttctgcactgaagtagcaccactaaacataggcacaacgagctaccttttttattacagtaattgttaacgtctatttcctattgaatcataggttaatgaattatgattaggtcgtcattgtcttacatatactttctagaaaacatttcaatttattatgacaaattacgtcagtaaattcatttaacctttttgtctttttaagaaacttttatgacctctatttacttaacttcatatataatcaataaaacaaaagaagtgaaaagagaagattgcagccaagaggaattcgttacaaacatgtatgagattttttaagttttttttgtttttaattattcctatttcacgttcacatggaaaagtcagaaagcataactactctaggccgggcgccgtggcacacgcctgtaatcccagcactctgggaggccaaggcaagtggatggcttgagtccaggagttttgataccagcctggggaatatagtgaaaccccgtctgtcctaaaaatacaaaaaattagctgggcatggttgcgtgtgcctctaatcccagctacctgggaggctgaggtggggagaatcacctgagcccagaaagtcaaggctgcagtgagctaagattgcgcgactgcactctagcctgagcaaccaaagtgagaccctgtctcaaaaggaaagcataactgcaaaaa

SEQ ID NO: 419431 - DNA, 636 bp, Homo sapiens
ggcgaggggcgggcgtcggggacattaccggacaggccttgtccggcaataccaagtttcatgcaggctcttgggaaagctggtgctgctgctgcctgattcccgccgacagaccttgggaccggggccaacactggcagctggagatggcggacacgagatccgtgcacgagactaggtttgaggcggccgtgaaggtgatccagagtttgccgaagaatgtcattccacacaacatacgagcagacgctcgacatcgcagagcatgcagctaagcaggcacactgagaggaccccggcgaacagcacaggcacggagacaggagcacccagagttagcgcgcaaaataactggcgaagcacggagagacactgacgggaatgaccaaagaggaaagccaggactagccagtacgcggaagaacgtgaagaggacgatggacaacgatgccacagacgtgcagaccagacgcaggaagagaagcggcacgaaggcacagaagggaacacagacgacggcacaaacagagtgaccgggacgcgtaagaaaaggcagcagagaccggagaaggaggagaccaagagtgtcacgacaaaacagcgcacagagaatagtcgacgacaaagggaaaaaac

SEQ ID NO: 419432 - DNA, 380 bp, Homo sapiens
cggcacgaggtttactgcaacttttgtagaattttatttgtgctacaagacacgttgcataggaaactatttaaagcccctgaggaaaaaatatccatggtttaaggtgcaactggttttgtttcttctttggggaaaaggtgatagatggtctctgggagaaattatggggtggagttgagaagcacaatcgaaggttatatggtgggatgattggcgaattgtgtgtcctggttcttgcagcataaaatagctaatgtttgttcctgctttgtttaataagaacctcatttaaacttgacagctatggtatttttttaatgataacttcttttctgtttattgtaaaactaagttaaaaataaaaggttaatgagaaa

SEQ ID NO: 419433 - DNA, 3918 bp, Homo sapiens
gggagggcacggactgacagacggactccggcggaatggggggtgtggctgctccgccagggtccccagggtgggagagcggctccgcggccaccgatgcccggaccccctctgtcttctgctagacatgctcttcctctcgtttcatgcaggctcttgggaaagctggtgctgctgctgcctgattcccgccgacagaccttgggaccggggccaacactggcagctggagatggcggacacgagatccgtgcacgagactaggtttgaggcggccgtgaaggtgatccagagtttgccgaagaatggttcattccagccaacaaatgaaatgatgcttaaattttatagcttctataagcaggcaactgaaggaccctgtaaactttcaaggcctggattttgggatcctattggaagatataaatgggatgcttggagttcactgggtgatatgaccaaagaggaagccatgattgcatatgttgaagaaatgaaaaagattattgaaactatgccaatgactgagaaagttgaagaattgctgcgtgtcataggtccattttatgaaattgtcgaggacaaaaagagtggcaggagttctgatataacctcagatcttggtaatgttctcacttctactccaaacgccaaaaccgttaatggtaaagctgaaagcagtgacagtggagccgagtctgaggaagaagaggcccaagaagaagtgaaaggagcagaacaaagtgataatgataagaaaatgatgaagaagtcagcagaccataagaatttggaagtcattgtcactaatggctatgataaagatggctttgttcaggatatacagaatgacattcatgccagttcttccctgaatggcagaagcactgaagaagtaaagcccattgatgaaaacttggggcaaactggaaaatctgctgtttgcattcaccaagatataaatgatgatcatgttgaagatgttacaggaattcagcatttgacaagcgattcagacagtgaagtttactgtgattctatggaacaatttggacaagaagagtctttagacagctttacgtccaacaatggaccatttcagtattacttgggtggtcattccagtcaacccatggaaaattctggatttcgtgaagatattcaagtacctcctggaaatggcaacattgggaatatgcaggtggttgcagttgaaggaaaaggtgaagtcaagcatggaggagaagatggcaggaataacagcggagcaccacaccgggagaagcgaggcggagaaactgacgaattctctaatgttagaagaggaagaggacataggatgcaacacttgagcgaaggaaccaagggccggcaggtgggaagtggaggtgatggggagcgctggggctccgacagagggtcccgaggcagcctcaatgagcagatcgccctcgtgctgatgagactgcaggaggacatgcagaatgtccttcagagactgcagaaactggaaacgctgactgctttgcaggcaaaatcatcaacatcaacattgcagactgctcctcagcccacctcacagagaccatcttggtggcccttcgagatgtctcctggtgtgctaacgtttgccatcatatggccttttattgcacagtggttggtgtatttatactatcaaagaaggagaagaaaactgaactgaggaaaatggtgttttcctcaagaagactactggaactggatgacctcagaatgaactggattgtggtgttcacaagaaaatcttagtttgtgatgattacattgctttttgttgtccagtagtttagtttgtgtacatatatacacatatatattttgcactacacaaacgataacattttaaggactaatattgctgatacttgaataatcaatctctactaggttataagtagtatacacagatttaccctgcccttgaacttgaaggacattaaattattaatgatcatttggtaacatgtttacctgattatcttccatagagtaacataagctgcttttcaaaggtaccattgtgataatgagatcaaatttataagttattatttttaattttctaaattaaataaaagaaagaatgcaaaccaggagtgaatttcaaatgagatgtaatcgactttatatcttagtcacggagttgccatggcatgtagtagaaaaccacaggaagaatggtcatattcactttgtgggctgcccataatctttcttgggcattcacaactcttgagtttggtgttcaggcatcattattaaaaagtggagtcctatgtaccagactgagtttttacaaatgatttgcaggctagacataacccactgatggaaatggtgaagaatgagcttcatgtaggtttaaaagtgtattctgagcctgtagatgattaatcaggtttttattcaatcatataaatgtattcctttgtaatcatttttgtttaactgaggatatctagtgtctgcttcatagggtgctttgaaatataaaatgaaaacttatttatactgtttttacaacagtcaaaaaggaaacacacgaaaatcacttttctgcaactgatgaactatatagactggactcttaacctcttagtgcctcagtttttccttcggggtatactattttagatacacctacttcacaggagtactggagggatttgcaagctaacgggccaaatgcttccataggaataaggcatgcccagctaacagaaatttaagtccctcttccccacctctctcatctagaccaaaaagaagactacaatttagatccttggagacttttcctgtatgccttccaaaacttcctgctcacttagatgtaccttgtgctttgaagatttctttgatgcagtctttgtaacaaataatttttttttttaaatggagtttctctcttgttgcccaggctggagggcaatggcgtgatcttggctcactgcaacttccacctcctgggttcaagtgattctcctgcctcactcccaagtagctgggattacaggcatgcaccaccatgcctggctaattttgtatttttagtagagacggggtttctccatgttggtaaggctgatctcaaactcccaacctcaggtgatctgcctgcctcggcctcccaaagtgctgggattagaggcgtgagccactgcacctggcctgtagcaaataatttttaagcattctcaagatgtatgatgttgggtttaacatcatatgttcacagtgttttaaataagaaataatctgtctttagtatacaggatggttctttgtttgcctgaaaagtataagaatacaatttacttttcccaaactctttttccttatttttttctttcaaataactttaattatttaatcccatactgattaaaatatgtctgtctaaagggatctactactatttgcttttaaaaaagtgttccctatttatttaggaaaaagtgaagcaagcaactgaatttatatgtaaaaataacatttagacctgtggatcaaagattattttcaaaaatgagatatcaatttggtatcagtaaaaagtgtcttttctcttagtatataaataaataaaatgcaaattaagagtgtaagcagttgtgaatcattacaagcagtctgggataactaactcctagggataaccatttctatcctgttccaaagtcttattttatagtttgaaaagcactttgcacacagttcttgtatataaaagtaaagatgtaattataggatatagtgttcctgctttgtttaataagaacctcatttaaacttgacagctatggtatttttttaatgataacttcttttctgtttattgtaaaactaagttaaaaataaaaggttaatgagaaa

SEQ ID NO: 419434 - DNA, 802 bp, Homo sapiens
  misc_feature (769)..(770): n is a, c, g, or t
ggcgaggggcgggcgtcggggacattaccggacaggccttgtccggcaataccaagtttcatgcaggctcttgggaaagctggtgctgctgctgcctgattcccgccgacagaccttgggaccggggccaacactggcagctggagatggcggacacgagatccgtgcacgagactaggtttgaggcggccgtgaaggtgatccagagtttgccgaagaatgaattctcctgcctcaggctcctgagtagctgggattacaattgcatgccaccacacctggctaatttttgtatttttagtagagacagggttttgccatgttggccaggctggtcttgaactcctgacctcaggtgatccgcccgtctcagcctcccaaagtgctgggattacaggtgtgagccacagctcctggccacactttggagatttagatctcaaagaaataacagaggaaaatgaataaaacacagttttacttgtataagaattatttaaaacaagcttatttttgcctcttaaaataggacataggatgcaacacttgagcgaaggaaccaagggccggcaggtgggaagtggaggtgatggggagcgctggggctccgacagagggtcccgaggcagcctcaatgagcagatcgccctcgtgctgatgagactgcaggaggacatgcagaatgtccttcagagactgcagaaactggaaacgctgactgctttgcaggaaattccaaagttctacctaatgggtatgaaccgatccnnaaaaagaccaaccctctgccagtcgccccccc

SEQ ID NO: 419435 - DNA, 3988 bp, Homo sapiens
gggagggcacggactgacagacggactccggcggaatggggggtgtggctgctccgccagggtccccagggtgggagagcggctccgcggccaccgatgcccggaccccctctgtcttctgctagacatgctcttcctctcgtttcatgcaggctcttgggaaagctggtgctgctgctgcctgattcccgccgacagaccttgggaccggggccaacactggcagctggagatggcggacacgagatccgtgcacgagactaggtttgaggcggccgtgaaggtgatccagagtttgccgaagaatggttcattccagccaacaaatgaaatgatgcttaaattttatagcttctataagcaggcaactgaaggaccctgtaaactttcaaggcctggattttgggatcctattggaagatataaatgggatgcttggagttcactgggtgatatgaccaaagaggaagccatgattgcatatgttgaagaaatgaaaaagattattgaaactatgccaatgactgagaaagttgaagaattgctgcgtgtcataggtccattttatgaaattgtcgaggacaaaaagagtggcaggagttctgatataacctcagatcttggtaatgttctcacttctactccaaacgccaaaaccgttaatggtaaagctgaaagcagtgacagtggagccgagtctgaggaagaagaggcccaagaagaagtgaaaggagcagaacaaagtgataatgataagaaaatgatgaagaagtcagcagaccataagaatttggaagtcattgtcactaatggctatgataaagatggctttgttcaggatatacagaatgacattcatgccagttcttccctgaatggcagaagcactgaagaagtaaagcccattgatgaaaacttggggcaaactggaaaatctgctgtttgcattcaccaagatataaatgatgatcatgttgaagatgttacaggaattcagcatttgacaagcgattcagacagtgaagtttactgtgattctatggaacaatttggacaagaagagtctttagacagctttacgtccaacaatggaccatttcagtattacttgggtggtcattccagtcaacccatggaaaattctggatttcgtgaagatattcaagtacctcctggaaatggcaacattgggaatatgcaggtggttgcagttgaaggaaaaggtgaagtcaagcatggaggagaagatggcaggaataacagcggagcaccacaccgggagaagcgaggcggagaaactgacgaattctctaatgttagaagaggaagaggacataggatgcaacacttgagcgaaggaaccaagggccggcaggtgggaagtggaggtgatggggagcgctggggctccgacagagggtcccgaggcagcctcaatgagcagatcgccctcgtgctgatgagactgcaggaggacatgcagaatgtccttcagagactgcagaaactggaaacgctgactgctttgcaggcaaaatcatcaacatcaacattgcagactgctcctcagcccacctcacagagaccatcttggtggcccttcgagatgtctcctggtgtgctaacgtttgccatcatatggccttttattgcacagtggttggtgtatttatactatcaaagaaggagaagaaaactgaactgaggaaaatggtgttttcctcaagaagactactggaactggatgacctcagaatgaactggattgtggtgttcacaagaaaatcttagtttgtgatgattacattgctttttgttgtccagtagtttagtttgtgtacatatatacacatatatattttgcactacacaaacgataacattttaaggactaatattgctgatacttgaataatcaatctctactaggttataagtagtatacacagatttaccctgcccttgaacttgaaggacattaaattattaatgatcatttggtaacatgtttacctgattatcttccatagagtaacataagctgcttttcaaaggtaccattgtgataatgagatcaaatttataagttattatttttaattttctaaattaaataaaagaaagaatgcaaaccaggagtgaatttcaaatgagatgtaatcgactttatatcttagtcacggagttgccatggcatgtagtagaaaaccacaggaagaatggtcatattcactttgtgggctgcccataatctttcttgggcattcacaactcttgagtttggtgttcaggcatcattattaaaaagtggagtcctatgtaccagactgagtttttacaaatgatttgcaggctagacataacccactgatggaaatggtgaagaatgagcttcatgtaggtttaaaagtgtattctgagcctgtagatgattaatcaggtttttattcaatcatataaatgtattcctttgtaatcatttttgtttaactgaggatatctagtgtctgcttcatagggtgctttgaaatataaaatgaaaacttatttatactgtttttacaacagtcaaaaaggaaacacacgaaaatcacttttctgcaactgatgaactatatagactggactcttaacctcttagtgcctcagtttttccttcggggtatactattttagatacacctacttcacaggagtactggagggatttgcaagctaacgggccaaatgcttccataggaataaggcatgcccagctaacagaaatttaagtccctcttccccacctctctcatctagaccaaaaagaagactacaatttagatccttggagacttttcctgtatgccttccaaaacttcctgctcacttagatgtaccttgtgctttgaagatttctttgatgcagtctttgtaacaaataatttttttttttaaatggagtttctctcttgttgcccaggctggagggcaatggcgtgatcttggctcactgcaacttccacctcctgggttcaagtgattctcctgcctcactcccaagtagctgggattacaggcatgcaccaccatgcctggctaattttgtatttttagtagagacggggtttctccatgttggtaaggctgatctcaaactcccaacctcaggtgatctgcctgcctcggcctcccaaagtgctgggattagaggcgtgagccactgcacctggcctgtagcaaataatttttaagcattctcaagatgtatgatgttgggtttaacatcatatgttcacagtgttttaaataagaaataatctgtctttagtatacaggatggttctttgtttgcctgaaaagtataagaatacaatttacttttcccaaactctttttccttatttttttctttcaaataactttaattatttaatcccatactgattaaaatatgtctgtctaaagggatctactactatttgcttttaaaaaagtgttccctatttatttaggaaaaagtgaagcaagcaactgaatttatatgtaaaaataacatttagacctgtggatcaaagattattttcaaaaatgagatatcaatttggtatcagtaaaaagtgtcttttctcttagtatataaataaataaaatgcaaattaagagtgtaagcagttgtgaatcattacaagcagtctgggataactaactcctagggataaccatttctatcctgttccaaagtcttattttatagtttgaaaagcactttgcacacagttcttgtatataaaagtaaagatgtaattataggatatagtgttcctgctttgtttaataagaacctcatttaaacttgacagctatggtatttttttaatgataacttcttttctgtttattgtaaaactaagttaaaaataaaaggttaatgagaaaaaaaaagaagagaaaaaaaacactgtgtggggatcgggcctgagaagattttaagaaaaggttgggcggc

SEQ ID NO: 419436 - DNA, 3116 bp, Homo sapiens
ggcgaggggcgggcgtcggggacattaccggacaggccttgtccggcaataccaagtttcatgcaggctcttgggaaagctggtgctgctgctgcctgattcccgccgacagaccttgggaccggggccaacactggcagctggagatggcggacacgagatccgtgcacgagactaggtttgaggcggccgtgaaggtgatccagagtttgccgaagaatgaattctcctgcctcaggctcctgagtagctgggattacaattgcatgccaccacacctggctaatttttgtatttttagtagagacagggttttgccatgttggccaggctggtcttgaactcctgacctcaggtgatccgcccgtctcagcctcccaaagtgctgggattacaggtgtgagccacagctcctggccacactttggagatttagatctcaaagaaataacagaggaaaatgaataaaacacagttttacttgtataagaattatttaaaacaagcttatttttgcctcttaaaataggacataggatgcaacacttgagcgaaggaaccaagggccggcaggtgggaagtggaggtgatggggagcgctggggctccgacagagggtcccgaggcagcctcaatgagcagatcgccctcgtgctgatgagactgcaggaggacatgcagaatgtccttcagagactgcagaaactggaaacgctgactgctttgcaggcaaaatcatcaacatcaacattgcagactgctcctcagcccacctcacagagaccatcttggtggcccttcgagatgtctcctggtgtgctaacgtttgccatcatatggccttttattgcacagtggttggtgtatttatactatcaaagaaggagaagaaaactgaactgaggaaaatggtgttttcctcaagaagactactggaactggatgacctcagaatgaactggattgtggtgttcacaagaaaatcttagtttgtgatgattacattgctttttgttgtccagtagtttagtttgtgtacatatatacacatatatattttgcactacacaaacgataacattttaaggactaatattgctgatacttgaataatcaatctctactaggttataagtagtatacacagatttaccctgcccttgaacttgaaggacattaaattattaatgatcatttggtaacatgtttacctgattatcttccatagagtaacataagctgcttttcaaaggtaccattgtgataatgagatcaaatttataagttattatttttaattttctaaattaaataaaagaaagaatgcaaaccaggagtgaatttcaaatgagatgtaatcgactttatatcttagtcacggagttgccatggcatgtagtagaaaaccacaggaagaatggtcatattcactttgtgggctgcccataatctttcttgggcattcacaactcttgagtttggtgttcaggcatcattattaaaaagtggagtcctatgtaccagactgagtttttacaaatgatttgcaggctagacataacccactgatggaaatggtgaagaatgagcttcatgtaggtttaaaagtgtattctgagcctgtagatgattaatcaggtttttattcaatcatataaatgtattcctttgtaatcatttttgtttaactgaggatatctagtgtctgcttcatagggtgctttgaaatataaaatgaaaacttatttatactgtttttacaacagtcaaaaaggaaacacacgaaaatcacttttctgcaactgatgaactatatagactggactcttaacctcttagtgcctcagtttttccttcggggtatactattttagatacacctacttcacaggagtactggagggatttgcaagctaacgggccaaatgcttccataggaataaggcatgcccagctaacagaaatttaagtccctcttccccacctctctcatctagaccaaaaagaagactacaatttagatccttggagacttttcctgtatgccttccaaaacttcctgctcacttagatgtaccttgtgctttgaagatttctttgatgcagtctttgtaacaaataatttttttttttaaatggagtttctctcttgttgcccaggctggagggcaatggcgtgatcttggctcactgcaacttccacctcctgggttcaagtgattctcctgcctcactcccaagtagctgggattacaggcatgcaccaccatgcctggctaattttgtatttttagtagagacggggtttctccatgttggtaaggctgatctcaaactcccaacctcaggtgatctgcctgcctcggcctcccaaagtgctgggattagaggcgtgagccactgcacctggcctgtagcaaataatttttaagcattctcaagatgtatgatgttgggtttaacatcatatgttcacagtgttttaaataagaaataatctgtctttagtatacaggatggttctttgtttgcctgaaaagtataagaatacaatttacttttcccaaactctttttccttatttttttctttcaaataactttaattatttaatcccatactgattaaaatatgtctgtctaaagggatctactactatttgcttttaaaaaagtgttccctatttatttaggaaaaagtgaagcaagcaactgaatttatatgtaaaaataacatttagacctgtggatcaaagattattttcaaaaatgagatatcaatttggtatcagtaaaaagtgtcttttctcttagtatataaataaataaaatgcaaattaagagtgtaagcagttgtgaatcattacaagcagtctgggataactaactcctagggataaccatttctatcctgttccaaagtcttattttatagtttgaaaagcactttgcacacagttcttgtatataaaagtaaagatgtaattataggatatagtgttcctgctttgtttaataagaacctcatttaaacttgacagctatggtatttttttaatgataacttcttttctgtttattgtaaaactaagttaaaaataaaaggttaatgagaaa

SEQ ID NO: 419437 - DNA, 2835 bp, Homo sapiens
gggagggcacggactgacagacggactccggcggaatggggggtgtggctgctccgccagggtccccagggtgggagagcggctccgcggccaccgatgcccggaccccctctgtcttctgctagacatgctcttcctctcgtttcatgcaggctcttgggaaagctggtgctgctgctgcctgattcccgccgacagaccttgggaccggggccaacactggcagctggagatggcggacacgagatccgtgcacgagactaggtttgaggcggccgtgaaggtgatccagagtttgccgaagaatggttcattccagccaacaaatgaaatgatgcttaaattttatagcttctataagcaggcaactgaaggaccctgtaaactttcaaggcctggattttgggatcctattggaagatataaatgggatgcttggagttcactgggtgatatgaccaaagaggaagccatgattgcatatgttgaagaaatgaaaaagattattgaaactatgccaatgactgagaaagttgaagaattgctgcgtgtcataggtccattttatgaaattgtcgaggacaaaaagagtggcaggagttctgatataacctcagatcttggtaatgttctcacttctactccaaacgccaaaaccgttaatggtaaagctgaaagcagtgacagtggagccgagtctgaggaagaagaggcccaagaagaagtgaaaggagcagaacaaagtgataatgataagaaaatgatgaagaagtcagcagaccataagaatttggaagtcattgtcactaatggctatgataaagatggctttgttcaggatatacagaatgacattcatgccagttcttccctgaatggcagaagcactgaagaagtaaagcccattgatgaaaacttggggcaaactggaaaatctgctgtttgcattcaccaagatataaatgatgatcatgttgaagatgttacaggaattcagcatttgacaagcgattcagacagtgaagtttactgtgattctatggaacaatttggacaagaagagtctttagacagctttacgtccaacaatggaccatttcagtattacttgggtggtcattccagtcaacccatggaaaattctggatttcgtgaagatattcaagtacctcctggaaatggcaacattgggaatatgcaggtggttgcagttgaaggaaaaggtgaagtcaagcatggaggagaagatggcaggaataacagcggagcaccacaccgggagaagcgaggcggagaaactgacgaattctctaatgttagaagaggaagaggacataggatgcaacacttgagcgaaggaaccaagggccggcaggtgggaagtggaggtgatggggagcgctggggctccgacagagggtcccgaggcagcctcaatgagcagatcgccctcgtgctgatgagactgcaggaggacatgcagaatgtccttcagagactgcagaaactggaaacgctgactgctttgcaggcaaaatcatcaacatcaacattgcagactgctcctcagcccacctcacagagaccatcttggtggcccttcgagatgtctcctggtgtgctaacgtttgccatcatatggccttttattgcacagtggttggtgtatttatactatcaaagaaggagaagaaaactgaactgaggaaaatggtgttttcctcaagaagactactggaactggatgacctcagaatgaactggattgtggtgttcacaagaaaatcttagtttgtgatgattacattgctttttgttgtccagtagtttagtttgtgtacatatatacacatatatattttgcactacacaaacgataacattttaaggactaatattgctgatacttgaataatcaatctctactaggttataagtagtatacacagatttaccctgcccttgaacttgaaggacattaaattattaatgatcatttggtaacatgtttacctgattatcttccatagagtaacataagctgcttttcaaaggtaccattgtgataatgagatcaaatttataagttattatttttaattttctaaattaaataaaagaaagaatgcaaaccaggagtgaatttcaaatgagatgtaatcgactttatatcttagtcacggagttgccatggcatgtagtagaaaaccacaggaagaatggtcatattcactttgtgggctgcccataatctttcttgggcattcacaactcttgagtttggtgttcaggcatcattattaaaaagtggagtcctatgtaccagactgagtttttacaaatgatttgcaggctagacataacccactgatggaaatggtgaagaatgagcttcatgtaggtttaaaagtgtattctgagcctgtagatgattaatcaggtttttattcaatcatataaatgtattcctttgtaatcatttttgtttaactgaggatatctagtgtctgcttcatagggtgctttgaaatataaaatgaaaacttatttatactgtttttacaacagtcaaaaaggaaacacacgaaaatcacttttctgcaactgatgaactatatagactggactcttaacctcttagtgcctcagtttttccttcggggtatactattttagatacacctacttcacaggagtactggagggatttgcaagctaacgggccaaatgcttccataggaataaagctactactccgcctcactgttaactctggtcagctgttgcacatgatttaccagattcactgccgtcgtgatacactggaacagctat

SEQ ID NO: 419438 - DNA, 3112 bp, Homo sapiens
actgcatttcaccctagagaaagaatgctggcaaagatctctaccacatggaaactgttcttaaagctgctgggccctgaaattttactcagcagtttgaaatcaagacatagcttttctcattcaccctcccacttggggctaatgcacagacatgaacatctattgaggaaaaccacaaaaaacttcaaaacagctacaacggtatcctaagaatatttcaattaaatattagtatgtctgctgaaggcactaattattaagaaacttaaaattatcaatctttcttgaatttctgatagagaagtaaaactattttccaaaactatttttcagaatgttcactgatacataaaaactgctagcatctaattaaagatcactaagggttaaatactgttctctggcccttactgcgcacaccctgccaaaacatcctctaagcttttaaatattgcttcgatggtctgaatttttatttccagggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgagtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagactacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccatctaaatagaaag

SEQ ID NO: 419439 - DNA, 2929 bp, Homo sapiens
actgcatttcaccctagagaaagaatgctggcaaagatctctaccacatggaaactgttcttaaagctgctgggccctgaaattttactcagcagtttgaaatcaagacatagcttttctcattcaccctcccacttggggctaatgcacagacatgaacatctattgaggaaaaccacaaaaaacttcaaaacagctacaacgggttaaatactgttctctggcccttactgcgcacaccctgccaaaacatcctctaagcttttaaatattgcttcgatggtctgaatttttatttccagggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgagtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagactacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccatctaaatagaaag

SEQ ID NO: 419440 - DNA, 206 bp, Homo sapiens
gcacgagcacaatagtgagtacatttgaaagtaaaaagtataaagctgcattttgcgctctcagtgaggtttaagtcagggaaatgaggcatgcacgcaaaatgcagctttatactttttactttcaattgcctagcacaatagtgagtacatttgaattgaatatataataaatattgcaaaataaaatccatctaaatagaaag

SEQ ID NO: 419441 - DNA, 296 bp, Homo sapiens
gcacgagcacaatagtgagtacatttgaaagtaaaaagtataaagctgcattttgcgctctcagtgaggtttaagtcagggaaatgaggcatgcacacaaaataacgagaaagtagtataatagctgtgatcattagttatcaaaagtgcatgcctcatttccctgacttaaacctcactgagagcgcaaaatgcagctttatactttttactttcaattgcctagcacaatagtgagtacatttgaattgaatatataataaatattgcaaaataaaatccatctaaatagaaag

SEQ ID NO: 419442 - DNA, 2401 bp, Homo sapiens
ttattgatgtttcatacatagccagtccgtatatatagcaataccccaaaggccaaaaatcccttcaagaaactgaataacctcaccttcctctacttggaccataatgccctggaatccgtgcctcttaatttaccagaaagtctacgtgtaattcatcttcaggtatgatagttcctttcacaatatctgactctaattacctatgagtcaaaatcttgtgactcattgggaacctcacttattcacatacaaattttggttagatcactgtagtagcgtgatagctaaatgtctgcctatcaaaaagattaatactaggctcatgaactttcttcccagaagtccagattccatccagagcataacaagtagaccagcacagtacgtgtgaagtctgctcttgattgtatttgtctccaggtgtacatttgagtatttcctaattaatttgacacaaggatttgaagtgagggggcactcagacctctgacttaggtttcctttacccattatatagcatatgaaaggttgatttcagatttctgaacaatgttttcctcgttttttttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgagtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagactacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccatctaaatagaaag

SEQ ID NO: 419443 - DNA, 1782 bp, Homo sapiens
actgcatttcaccctagagaaagaatgctggcaaagatctctaccacatggaaactgttcttaaagctgctgggccctgaaattttactcagcagtttgaaatcaagacatagcttttctcattcaccctcccacttggggctaatgcacagacatgaacatctattgaggaaaaccacaaaaaacttcaaaacagctacaacgggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgagtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctga

SEQ ID NO: 419444 - DNA, 1019 bp, Homo sapiens
actgcatttcaccctagagaaagaatgctggcaaagatctctaccacatggaaactgttcttaaagctgctgggccctgaaattttactcagcagtttgaaatcaagacatagcttttctcattcaccctcccacttggggctaatgcacagacatgaacatctattgaggaaaaccacaaaaaacttcaaaacagctacaacgggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatggtaagtatcattctaaatatttttcaaatggatcttttaaaaatagctataatggactttattccttgtggtaatcaaaaactgactcaagatacagtaaatacaaactagtggaattttatttccaatgataaactcaaactgggagtgcacaccatttgccatcccacattatgagtgagaaatgtggagcaagaacttgtgagaacaaccaaagcttaggcaagcttagcctccacaaagtgtggtttccatccatataaaatctattcgagaaatacttaaacacggattatttgcaaaatacaatgtgcagcctcagtatacggtaaatataattattgcctttaagaaacttacagaacagaaacacacatatacatcaataattacacatacatttcaattaaaatagaaaacttgtcatgaaataacaaattacaaatcctacttaataattccagtgtacgtg

SEQ ID NO: 419445 - DNA, 2831 bp, Homo sapiens
actgcatttcaccctagagaaagaatgctggcaaagatctctaccacatggaaactgttcttaaagctgctgggccctgaaattttactcagcagtttgaaatcaagacatagcttttctcattcaccctcccacttggggctaatgcacagacatgaacatctattgaggaaaaccacaaaaaacttcaaaacagctacaacgggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgagtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagactacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccatctaaatagaaag

SEQ ID NO: 419446 - DNA, 2750 bp, Homo sapiens
actgcatttcaccctagagaaagaatgctggcaaagatctctaccacatggaaactgttcttaaagctgctgggccctgaaattttactcagcagtttgaaatcaagacatagcttttctcattcaccctcccacttggggctaatgcacagacatgaacatctattgaggaaaaccacaaaaaacttcaaaacagctacaacgactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgagtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagactacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccatctaaatagaaag

SEQ ID NO: 419447 - DNA, 1130 bp, Homo sapiens
actgcatttcaccctagagaaagaatgctggcaaagatctctaccacatggaaactgttcttaaagctgctgggccctgaaattttactcagcagtttgaaatcaagacatagcttttctcattcaccctcccacttggggctaatgcacagacatgaacatctattgaggaaaaccacaaaaaacttcaaaacagctacaacgggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaagtaagtattttatagtaaaactaagcatagtatgagtgatgatatgatagataaaagagaaactttggtctagaattgtattttgattacacttaaaaactattttgatttaataaatgaagacattatttacataataaataaccatcctattaggctcattcagcctagcttatacccatatctcagttaaaatacataacctttattttaaaaaaaaa

SEQ ID NO: 419448 - DNA, 1924 bp, Homo sapiens
  misc_feature (1118)..(1118): n is a, c, g, or t
ttttcttgtctaatggtgttggtgaatactccagaattttgtcagagaacagtggcagtagcagatactctcattttcttcttggcctaacagaagtgcttctagcatttgaccattaaagtgctgtcctggaagcggagacaggtgcattttgtcatgtggtagtgaagtccatccactcttcttttattagatttaaaacaccaagaatgcacattaaacaagctctagtgctgttatggacataatgaaatgactgtgcgtcttggagctattaattgtaggatatccctaaatactggatgattgctgcatccgtcgaaaatctgacgtggtcgctgaattctcgttatccatgccatgtgctgcagagctcagcttgctgacattttgttttggatttcgcactgatgcttctaaataagactgtcacagttttctttatagtgtttggaacctcagtttgctttgttcaaaagataatttgagtttaaatagcagcagtgtcctctgccccacagggttggatttcccataaaacctgagtctagtgttttggggtccagggcttaagaaagttttctgtctcttccatacagttggcctgtgggggtctctggcttttcctcggtgatttctgcagcgccccccacaccccgttagaacccagagttgggcaggggagggctgggggtgaggttggttggaactggcttcacaggcttggctctgccattctctagctctgcagacccctgctgtgggttctcccagaccctcccagggtgagcagtgagggtgctggggctgcccctgctcctttaatggaggtgtctccatgtcggtctgggtctgaatgcccagagggctgggagggctggctgtgacccagaggggccacaggaggggtggcaagcgtgaccttgtcaggccctacccgctgcctgtgtctccagggagagcccgggccacccggacagatgggaccagaaggtcctggaggccagcagggctcgccggggacccagggccgtgcagtccaggggcctgtggtaggtgtcactccttccctgccctcctgccctgtgccccctccgcttcgctgtccagcccatctnccccctccagggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 419449 - DNA, 1221 bp, Homo sapiens
acagacgtctcaggaaactgggggcaacctggggggagccccgtgggctgtgggaacccctgcccccggcttggaagctgcccacagtggcctggttgcagcctggcagatgaggggtacatcactactcagaataaacggccccctctgcacccacctgtctagatgagggtgacaggcactatcacagggcccccacctgacgccttcccacctggccatgcccccccagaactgtcatggagcccaggaggcgcctgtgtggagcacggggacctggcacgctgctgcccctagatctcagactcccatctaaggaccagacctgctgcctgtgcccagggaggggccctgacaccctctgtccccgtcagaacagggccccaagccactgcattgctccgtcctcacatgccctccctttcctcgcaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggggggaaattttctctccggggggggcgctggactttttgtagaaaagaagggggccccccctaggaggggagccgtctaataataagcaacgagcgggcgagggccgcgcgcgctttaaaaacagtggtggggcgggagagacaacacccgtcgtttgctgctgctcctttgtctggacgaaaggagacgaccacacctcctgggtggggggggagcacaaatgtggggagaacaccacccacacgaagagaagatttttaccccctcggggggagaaatacaatatccggcggggggtgatgtgggggggtgaccacacaccaggtgagtatatctgtcgtgcgcgaagaaaaactagtttgcctagaggggcattcttcataggaaaacttttcgcg

SEQ ID NO: 419450 - DNA, 1849 bp, Homo sapiens
gggctgtggagaacctcccgtgccgtctcacaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggtccaccaggggtcaaaggagagaagggagaccatgggcttccaggcttgcagggcaacccggacacaggacatccccgggagagtatggctccagggaccaagggaatgagaggctgagggactgctggctgcttgaacccctgagccccagcgggttccaggcataggcagggggcaggggcactagtggagagcgaggacatcagggaccgtgcggccacatggatgccatgtccaaatggggacagaggacaaatgggaaccagagacattgcaactttaacacgtgtcagccaggctgaatatgcaccaagaacatggccagtggacttacagagacacagaccagacatagcacaaaaggacgcccggcgcggggcacatgcccgaagcacccacgtaagttgtaggacgagcggaaccaccgcgctcgatggcctcactcccctccgtaccgctcacgctcgtcagctcaccgcgctgggggggccaccgcaagacgagactcgagcagacacgacgcacacgcagcgacccagagcacgcaccagacccaagcagacacaaggccccccatccgcacaacgaacgcagcacgaccaccccaacacacgagccaccgcccccacagccgacacctccgaccaacactcagcaccaacacaaaatactcaccacatactccgatccagaccaagcaaaacaactacaccaccgcgtcacaggacaccaagtcaaccccaaccaactatattaccaagtcccacagtctacactacattcgcacactacaaccaccaacggacgaccaacacacgccactcaaccatccaccacaagtcagatacacagaacagacaacacacccactcagaggcgcacagcacatcacacatacgcacgcaataccttccacaacgaccactacgaaccacaatcagctcagagagaacacgaagcacagaacaacacgacgagacaacacaacggcaagcaggcgcgagagacgcagaagagaagaaaggacgaagagcgagaaaaggacagcgacgagagagacggggacacgcgacaggcgcatcgcagatcacgagacccggaagaacgagagacgaacaggccagcaacagacagagacgagagctcagaagaacgcgagcatgcctgacccgaccgaagacgagggaactgcgtaagcaggcgcaagaaagactcaggacgaacccaacagccacaaagaacgaagcacaagaagagagcacagagctaacacagagccacgaccccacgagcaggaatgacaagagagcgagaagcagcaggaagacatcgacgagaacgcagagaagggagaccggagagtggagatgcgaatgatgagatggcgggactgttgagagatgccagagaaattgacggcggagcactctacaga

SEQ ID NO: 419451 - DNA, 8135 bp, Homo sapiens
  misc_feature (1963)..(1963): n is a, c, g, or t
agcggataagctccagccttcctgtggccacagcaggaccagagtggaccagcacaccccaggagagaggactggggtcccaggagtaggaggagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcacacacacggggagcccagaccctgagcaggcttctgagccccaagttgccttcaaaccaagccaggatccgcgcactcctggtgggtcagagtggagagagaccggcccccagtaccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggaggggcccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccangctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcacccagccaagcgaggcgggagtcatttcctgggagagtgtcccccaccctggctctgtgcaccccaccttgaggccctgcagcttcagccgcagtggggaaggggaggggctgggctgatggcgaatcgggttcaggagggcagcagtgccctgtggccgtctcagtagctctaaaacaggctcaacaacatgccccgcccctttctctgggcctcatctaagcctggccagggccctgtgggcccgcctctctctgcgcctcacgcaggcaacagatggttccactgctggcccaccagtcacctgcacgatggctcctccctcagaacagcactcccaccccggccccagcaccttcacatctgggcacaggcaggtccctgcctgcctcatcgtcccctctgtccccagcccaagaaggagttcagatcctgtgtgtgaatggccacccctcacccacccagccctgtgctgagttccttgtgcagggacattgctttgagacttggcaccatcagcccctggtccttagggtctcagagcaaggtcatccctcagcaggcttctggcctgtgcgctcctcagcacctctgcccaggtctctcccaaccatcacagacgctgtgtgagcctggacttcctgccttatccccactgtggcccaaacagcatgggggcaagctcagaacacacacctgggcttctgggccttgtggcccgtgggggtgatgtgggaacttctacttcctttccaaacaaatattcagtaactagtccactgttaccacttaggcagctaagcaagaaaggtgccagaaatgaagagggaagccatatcattgaggagagaatgaaaagtattaaaaaggaacaaagagagacccttgatattgacagaaggaaaacccaccaagatcaccagtgcagcattgcgtgcaccaaagcataccccaaagaggtgagcgcaaaacagcttcagggcaaacacttcatctatgattcaactgttccaggaactgaccagacctggagaccaaatagagagtcataggcagggtcagcaggatgggagagagcgcctgcacccacaggagccacagccctgactgaggccaggaagcagccccaaatgccagctcccactgcagcatgagaacagaaacagaccactgaaaattcccaaagtctgtggacaaatcagacgtcgaagaagtcacgtggcatcgagacagattttgcactgagggacaaggagagcatgtggccaaagtaggtgcaggtaaagcagcatctggggcagagttatagccttcagtgcaggtatcagacacagttgttgagagcagcagcccaagccagcccctccgtcctgcagggaggacacctaggtcacttggcttctgttggggagctgagttgcttcagattgtgtgaccagcaaaacagcttggttgctctcacttggtttctccagggcggggaattacatgtccccagctgaactgagaaggctctttgagcagtggagtgagcaggctttgtcatgaggcaggagtggggctagaatcaagcccagagcccacagggcatccagagccttccaaaggagcccctctcctggggctctccaatttgatgaagggactgggcactgggtggctgagaccacattggcagccaggaggaggcagcctggccggggggaaccagggtggctctaatccccaccaccccctcagctgccctacccccgccacgctggtgtgacaccagtgatgctcagcctcaaaaggggagtccggctgtcttcgggaaactgactttatgctggaggccaattaaaatggcacagcaaaggcagcggccagctggtgcccaggcagcttagggactggtccctgaggccccacccgccccagcctgtgcagtggagctgagtacgaatcaaaggtgaggatggcaagggagctgagagcagcctccggatgcaccaaaccggcctggctcctgtttgcaggaaggcagcctccccgagacccagccgacctgcacgtctcccatcagccccgactccaccgcatccctctgggtccttttaggagcccccagggactgagccggggctcacgctcctggccagagcgctgggtttctggcaatgcctcccctcctgcctttacggccacagctctcccctccagaggcccctctgtagtgggcctcggtcccctctccacccccagaggcagcacagcttcagccctacgcagtgtgggggctccgggaggaaatgcagggaggtgcttggtcttggcccagagctcatggccttaggtgctgcccccagtcacccccgtgcccatgcagccggggatgttcagctcaggccagccaccgaggtggtgtgacgcaaggctgatctgacgctcagctcaggccgctggggtcatgggggttgtgggaaggtcatggaatcacggggctcacgctggggtcacagggtggtgtggctgtgtggactgtaaggggcgtgcagccatgcgtatctgacctgccctccctaggtctgcaggcagtgccgagtggctctgcctgaggccccaagagcgaccttggaagctccaggccttcacagcccctctgagagccacctgcaaggtggggagctgggaagaacggctcagtgatgagctcagagggaggggtgggcacagcgcccaggaaggcgggtgcgtgcaggcctgggaggaatgtgtagcaggaggcagggggtgctgtgcccgcaggaccagcaggtgaggcgtgtccacccacaggatggctctggcccaggcagtgtcagaaatggaagctgaggaaacccaaccccagctgtagaggagcctgccccgatgccatctgcacctggggggcgacgtatggctgccagcctcttcatctaccaaggaccagggcagtggggacgggagagctgggacacgtggactcacaccagggcagatggtgggggaagccagtgtctgtagattcagtgcatttcttggggaagggcgtggaacatttggacttgagccccagcacagagacgatgtcataatacagccccccatcgtgatctgatggtaagtacagaactccttgcccagtggagaaacactctcctctcatgtgtggaatatccacacactaaccatgaactgggccataagaaaccttacattccaaaggatcctgctgttcagaactcactcactcactgatgaaactggaaaaacaaccaatgataacaagctaaagaatgcctctagaagctaaaagacacacccatgactccacagtaattcatgggttaaagagaaaaaaggaaacgtgaagatacttgtaaccaaataatgatggatgcagcgccacgtcagaatctctgtgctgcagctgcagtggtacctagagggcaatttatagctgtaaatacagtgctttgttttgttttcttgttttttgagacaaggtcttgctctgtcacccaggctggagtacagtggcatgatctcggctcaatgcaacctctgtgccaccctgggctcaagtggtcctcctgctccggtcttctgagtagcaggaaccacaggcgtgcgccaccacgcttggctaatgttttttgtatttttttaaatagagacagggtgttgccgtgttacccaggctggtcttgaacttctgagctcaaacgatccaccctccttggcctcccaaagtggtgggattacaggtgtgagtcacctcaccggcccttaaacacagtttttagggaagattccaactcaaacaattttaaatagtagaaaataaaccctgaagcagtgtgcattcattagtactgtgtttgcctgtatttaattaaaacctgattgccattggct

SEQ ID NO: 419452 - DNA, 4293 bp, Homo sapiens
  misc_feature (1942)..(1942): n is a, c, g, or t
agcggataagctccagccttcctgtggccacagcaggaccagagtggaccagcacaccccaggagagaggactggggtcccaggagtaggaggagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcacacacacggggagcccagaccctgagcaggcttctgagccccaagttgccttcaaaccaagccaggatccgcgcactcctgccggcccccagtaccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggaggggcccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccangctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggagagcccgggccacccggacagatgggaccagaaggtcctggaggccagcagggctcgccggggacccagggccgtgcagtccaggggcctgtgggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 419453 - DNA, 8192 bp, Homo sapiens
  misc_feature (1942)..(1942): n is a, c, g, or t
agcggataagctccagccttcctgtggccacagcaggaccagagtggaccagcacaccccaggagagaggactggggtcccaggagtaggaggagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcacacacacggggagcccagaccctgagcaggcttctgagccccaagttgccttcaaaccaagccaggatccgcgcactcctgccggcccccagtaccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggaggggcccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccangctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggagagcccgggccacccggacagatgggaccagaaggtcctggaggccagcagggctcgccggggacccagggccgtgcagtccaggggcctgtgggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctcacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcacccagccaagcgaggcgggagtcatttcctgggagagtgtcccccaccctggctctgtgcaccccaccttgaggccctgcagcttcagccgcagtggggaaggggaggggctgggctgatggcgaatcgggttcaggagggcagcagtgccctgtggccgtctcagtagctctaaaacaggctcaacaacatgccccgcccctttctctgggcctcatctaagcctggccagggccctgtgggcccgcctctctctgcgcctcacgcaggcaacagatggttccactgctggcccaccagtcacctgcacgatggctcctccctcagaacagcactcccaccccggccccagcaccttcacatctgggcacaggcaggtccctgcctgcctcatcgtcccctctgtccccagcccaagaaggagttcagatcctgtgtgtgaatggccacccctcacccacccagccctgtgctgagttccttgtgcagggacattgctttgagacttggcaccatcagcccctggtccttagggtctcagagcaaggtcatccctcagcaggcttctggcctgtgcgctcctcagcacctctgcccaggtctctcccaaccatcacagacgctgtgtgagcctggacttcctgccttatccccactgtggcccaaacagcatgggggcaagctcagaacacacacctgggcttctgggccttgtggcccgtgggggtgatgtgggaacttctacttcctttccaaacaaatattcagtaactagtccactgttaccacttaggcagctaagcaagaaaggtgccagaaatgaagagggaagccatatcattgaggagagaatgaaaagtattaaaaaggaacaaagagagacccttgatattgacagaaggaaaacccaccaagatcaccagtgcagcattgcgtgcaccaaagcataccccaaagaggtgagcgcaaaacagcttcagggcaaacacttcatctatgattcaactgttccaggaactgaccagacctggagaccaaatagagagtcataggcagggtcagcaggatgggagagagcgcctgcacccacaggagccacagccctgactgaggccaggaagcagccccaaatgccagctcccactgcagcatgagaacagaaacagaccactgaaaattcccaaagtctgtggacaaatcagacgtcgaagaagtcacgtggcatcgagacagattttgcactgagggacaaggagagcatgtggccaaagtaggtgcaggtaaagcagcatctggggcagagttatagccttcagtgcaggtatcagacacagttgttgagagcagcagcccaagccagcccctccgtcctgcagggaggacacctaggtcacttggcttctgttggggagctgagttgcttcagattgtgtgaccagcaaaacagcttggttgctctcacttggtttctccagggcggggaattacatgtccccagctgaactgagaaggctctttgagcagtggagtgagcaggctttgtcatgaggcaggagtggggctagaatcaagcccagagcccacagggcatccagagccttccaaaggagcccctctcctggggctctccaatttgatgaagggactgggcactgggtggctgagaccacattggcagccaggaggaggcagcctggccggggggaaccagggtggctctaatccccaccaccccctcagctgccctacccccgccacgctggtgtgacaccagtgatgctcagcctcaaaaggggagtccggctgtcttcgggaaactgactttatgctggaggccaattaaaatggcacagcaaaggcagcggccagctggtgcccaggcagcttagggactggtccctgaggccccacccgccccagcctgtgcagtggagctgagtacgaatcaaaggtgaggatggcaagggagctgagagcagcctccggatgcaccaaaccggcctggctcctgtttgcaggaaggcagcctccccgagacccagccgacctgcacgtctcccatcagccccgactccaccgcatccctctgggtccttttaggagcccccagggactgagccggggctcacgctcctggccagagcgctgggtttctggcaatgcctcccctcctgcctttacggccacagctctcccctccagaggcccctctgtagtgggcctcggtcccctctccacccccagaggcagcacagcttcagccctacgcagtgtgggggctccgggaggaaatgcagggaggtgcttggtcttggcccagagctcatggccttaggtgctgcccccagtcacccccgtgcccatgcagccggggatgttcagctcaggccagccaccgaggtggtgtgacgcaaggctgatctgacgctcagctcaggccgctggggtcatgggggttgtgggaaggtcatggaatcacggggctcacgctggggtcacagggtggtgtggctgtgtggactgtaaggggcgtgcagccatgcgtatctgacctgccctccctaggtctgcaggcagtgccgagtggctctgcctgaggccccaagagcgaccttggaagctccaggccttcacagcccctctgagagccacctgcaaggtggggagctgggaagaacggctcagtgatgagctcagagggaggggtgggcacagcgcccaggaaggcgggtgcgtgcaggcctgggaggaatgtgtagcaggaggcagggggtgctgtgcccgcaggaccagcaggtgaggcgtgtccacccacaggatggctctggcccaggcagtgtcagaaatggaagctgaggaaacccaaccccagctgtagaggagcctgccccgatgccatctgcacctggggggcgacgtatggctgccagcctcttcatctaccaaggaccagggcagtggggacgggagagctgggacacgtggactcacaccagggcagatggtgggggaagccagtgtctgtagattcagtgcatttcttggggaagggcgtggaacatttggacttgagccccagcacagagacgatgtcataatacagccccccatcgtgatctgatggtaagtacagaactccttgcccagtggagaaacactctcctctcatgtgtggaatatccacacactaaccatgaactgggccataagaaaccttacattccaaaggatcctgctgttcagaactcactcactcactgatgaaactggaaaaacaaccaatgataacaagctaaagaatgcctctagaagctaaaagacacacccatgactccacagtaattcatgggttaaagagaaaaaaggaaacgtgaagatacttgtaaccaaataatgatggatgcagcgccacgtcagaatctctgtgctgcagctgcagtggtacctagagggcaatttatagctgtaaatacagtgctttgttttgttttcttgttttttgagacaaggtcttgctctgtcacccaggctggagtacagtggcatgatctcggctcaatgcaacctctgtgccaccctgggctcaagtggtcctcctgctccggtcttctgagtagcaggaaccacaggcgtgcgccaccacgcttggctaatgttttttgtatttttttaaatagagacagggtgttgccgtgttacccaggctggtcttgaacttctgagctcaaacgatccaccctccttggcctcccaaagtggtgggattacaggtgtgagtcacctcaccggcccttaaacacagtttttagggaagattccaactcaaacaattttaaatagtagaaaataaaccctgaagcagtgtgcattcattagtactgtgtttgcctgtatttaattaaaacctgattgccattggct

SEQ ID NO: 419454 - DNA, 4510 bp, Homo sapiens
  misc_feature (1942)..(1942): n is a, c, g, or t
agcggataagctccagccttcctgtggccacagcaggaccagagtggaccagcacaccccaggagagaggactggggtcccaggagtaggaggagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcacacacacggggagcccagaccctgagcaggcttctgagccccaagttgccttcaaaccaagccaggatccgcgcactcctgccggcccccagtaccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggaggggcccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccangctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcggtgtgccccgtcccttgcccctgttccacgaagcaagttagggcaagtgcccactgagggtcacagtgcctgggagggatggagagacctgccccgccttcgtgtctgcctgttcctgttcctcagagacccctgggcccccaggacctcaaggacccccagttccagcgccccacaggtgacggctggggcttccagagctggctctgggaccggtcaagcacactctctctgagctcagtgtccacagccttgtctactcagggggccggggtttgaacccagaactgcctgactatgagagggcctccctgggaggaatggcaccccaggagagcagggcttcccagggcccaggggagagcccgggccacccggacagatgggaccagaaggtcctggaggccagcagggctcgccggggacccagggccgtgcagtccaggggcctgtgggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 419455 - DNA, 4017 bp, Homo sapiens
  misc_feature (1942)..(1942): n is a, c, g, or t
agcggataagctccagccttcctgtggccacagcaggaccagagtggaccagcacaccccaggagagaggactggggtcccaggagtaggaggagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcacacacacggggagcccagaccctgagcaggcttctgagccccaagttgccttcaaaccaagccaggatccgcgcactcctgccggcccccagtaccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggaggggcccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccangctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggagagcccgggccacccggacagatgggaccagaaggtcctggaggccagcagggctcgccggggacccagggccgtgcagtccaggggcctgtgggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgcagggccaaagggaccaggagagaaggcgagcgagtccttgccacctctacagttgtgagcagggcctggagttgccattcgacaccgtgtccagtccggctcttcccgggaaaacagggcccccatgcccttttggggcccaacttgggacctcggacctgaagcccggggtccccggggaccgcaaaaaggcctggtctcgggcaatggggtggtggcgcacctcattggcaaggcgatacagagaggcaaacaagagccgccagcgaggacaacaag

SEQ ID NO: 419456 - DNA, 3126 bp, Homo sapiens
  misc_feature (1942)..(1942): n is a, c, g, or t
agcggataagctccagccttcctgtggccacagcaggaccagagtggaccagcacaccccaggagagaggactggggtcccaggagtaggaggagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcacacacacggggagcccagaccctgagcaggcttctgagccccaagttgccttcaaaccaagccaggatccgcgcactcctgccggcccccagtaccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggaggggcccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccangctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatggtgacgtgggccccgcgtcgcccccagcagtcaggaggagtaggggcagggaggccccagagccctgggaggccttcagaggaagtccagcctccaggccaggccctcagcaccctctgggtgggaggcaggtgtcccgggcagggggctgtgggccacattgagggtcacctccagcttggcaccctcagggctgctcctgtcctgtcgtgg

SEQ ID NO: 419457 - DNA, 8098 bp, Homo sapiens
  misc_feature (1926)..(1926): n is a, c, g, or t
gtcagggagaggacagacggggggacggctgaagggcatggcctcttccctgccacagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcacacacacggggagcccagaccctgagcaggcttctgagccccaagttgccttcaaaccaagccaggatccgcgcactcctggtgggtcagagtggagagagaccggcccccagtaccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggaggggcccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccangctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcacccagccaagcgaggcgggagtcatttcctgggagagtgtcccccaccctggctctgtgcaccccaccttgaggccctgcagcttcagccgcagtggggaaggggaggggctgggctgatggcgaatcgggttcaggagggcagcagtgccctgtggccgtctcagtagctctaaaacaggctcaacaacatgccccgcccctttctctgggcctcatctaagcctggccagggccctgtgggcccgcctctctctgcgcctcacgcaggcaacagatggttccactgctggcccaccagtcacctgcacgatggctcctccctcagaacagcactcccaccccggccccagcaccttcacatctgggcacaggcaggtccctgcctgcctcatcgtcccctctgtccccagcccaagaaggagttcagatcctgtgtgtgaatggccacccctcacccacccagccctgtgctgagttccttgtgcagggacattgctttgagacttggcaccatcagcccctggtccttagggtctcagagcaaggtcatccctcagcaggcttctggcctgtgcgctcctcagcacctctgcccaggtctctcccaaccatcacagacgctgtgtgagcctggacttcctgccttatccccactgtggcccaaacagcatgggggcaagctcagaacacacacctgggcttctgggccttgtggcccgtgggggtgatgtgggaacttctacttcctttccaaacaaatattcagtaactagtccactgttaccacttaggcagctaagcaagaaaggtgccagaaatgaagagggaagccatatcattgaggagagaatgaaaagtattaaaaaggaacaaagagagacccttgatattgacagaaggaaaacccaccaagatcaccagtgcagcattgcgtgcaccaaagcataccccaaagaggtgagcgcaaaacagcttcagggcaaacacttcatctatgattcaactgttccaggaactgaccagacctggagaccaaatagagagtcataggcagggtcagcaggatgggagagagcgcctgcacccacaggagccacagccctgactgaggccaggaagcagccccaaatgccagctcccactgcagcatgagaacagaaacagaccactgaaaattcccaaagtctgtggacaaatcagacgtcgaagaagtcacgtggcatcgagacagattttgcactgagggacaaggagagcatgtggccaaagtaggtgcaggtaaagcagcatctggggcagagttatagccttcagtgcaggtatcagacacagttgttgagagcagcagcccaagccagcccctccgtcctgcagggaggacacctaggtcacttggcttctgttggggagctgagttgcttcagattgtgtgaccagcaaaacagcttggttgctctcacttggtttctccagggcggggaattacatgtccccagctgaactgagaaggctctttgagcagtggagtgagcaggctttgtcatgaggcaggagtggggctagaatcaagcccagagcccacagggcatccagagccttccaaaggagcccctctcctggggctctccaatttgatgaagggactgggcactgggtggctgagaccacattggcagccaggaggaggcagcctggccggggggaaccagggtggctctaatccccaccaccccctcagctgccctacccccgccacgctggtgtgacaccagtgatgctcagcctcaaaaggggagtccggctgtcttcgggaaactgactttatgctggaggccaattaaaatggcacagcaaaggcagcggccagctggtgcccaggcagcttagggactggtccctgaggccccacccgccccagcctgtgcagtggagctgagtacgaatcaaaggtgaggatggcaagggagctgagagcagcctccggatgcaccaaaccggcctggctcctgtttgcaggaaggcagcctccccgagacccagccgacctgcacgtctcccatcagccccgactccaccgcatccctctgggtccttttaggagcccccagggactgagccggggctcacgctcctggccagagcgctgggtttctggcaatgcctcccctcctgcctttacggccacagctctcccctccagaggcccctctgtagtgggcctcggtcccctctccacccccagaggcagcacagcttcagccctacgcagtgtgggggctccgggaggaaatgcagggaggtgcttggtcttggcccagagctcatggccttaggtgctgcccccagtcacccccgtgcccatgcagccggggatgttcagctcaggccagccaccgaggtggtgtgacgcaaggctgatctgacgctcagctcaggccgctggggtcatgggggttgtgggaaggtcatggaatcacggggctcacgctggggtcacagggtggtgtggctgtgtggactgtaaggggcgtgcagccatgcgtatctgacctgccctccctaggtctgcaggcagtgccgagtggctctgcctgaggccccaagagcgaccttggaagctccaggccttcacagcccctctgagagccacctgcaaggtggggagctgggaagaacggctcagtgatgagctcagagggaggggtgggcacagcgcccaggaaggcgggtgcgtgcaggcctgggaggaatgtgtagcaggaggcagggggtgctgtgcccgcaggaccagcaggtgaggcgtgtccacccacaggatggctctggcccaggcagtgtcagaaatggaagctgaggaaacccaaccccagctgtagaggagcctgccccgatgccatctgcacctggggggcgacgtatggctgccagcctcttcatctaccaaggaccagggcagtggggacgggagagctgggacacgtggactcacaccagggcagatggtgggggaagccagtgtctgtagattcagtgcatttcttggggaagggcgtggaacatttggacttgagccccagcacagagacgatgtcataatacagccccccatcgtgatctgatggtaagtacagaactccttgcccagtggagaaacactctcctctcatgtgtggaatatccacacactaaccatgaactgggccataagaaaccttacattccaaaggatcctgctgttcagaactcactcactcactgatgaaactggaaaaacaaccaatgataacaagctaaagaatgcctctagaagctaaaagacacacccatgactccacagtaattcatgggttaaagagaaaaaaggaaacgtgaagatacttgtaaccaaataatgatggatgcagcgccacgtcagaatctctgtgctgcagctgcagtggtacctagagggcaatttatagctgtaaatacagtgctttgttttgttttcttgttttttgagacaaggtcttgctctgtcacccaggctggagtacagtggcatgatctcggctcaatgcaacctctgtgccaccctgggctcaagtggtcctcctgctccggtcttctgagtagcaggaaccacaggcgtgcgccaccacgcttggctaatgttttttgtatttttttaaatagagacagggtgttgccgtgttacccaggctggtcttgaacttctgagctcaaacgatccaccctccttggcctcccaaagtggtgggattacaggtgtgagtcacctcaccggcccttaaacacagtttttagggaagattccaactcaaacaattttaaatagtagaaaataaaccctgaagcagtgtgcattcattagtactgtgtttgcctgtatttaattaaaacctgattgccattggct

SEQ ID NO: 419458 - DNA, 4197 bp, Homo sapiens
  misc_feature (1942)..(1942): n is a, c, g, or t
agcggataagctccagccttcctgtggccacagcaggaccagagtggaccagcacaccccaggagagaggactggggtcccaggagtaggaggagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcacacacacggggagcccagaccctgagcaggcttctgagccccaagttgccttcaaaccaagccaggatccgcgcactcctgccggcccccagtaccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggaggggcccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccangctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 419459 - DNA, 4143 bp, Homo sapiens
  misc_feature (1942)..(1942): n is a, c, g, or t
agcggataagctccagccttcctgtggccacagcaggaccagagtggaccagcacaccccaggagagaggactggggtcccaggagtaggaggagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcacacacacggggagcccagaccctgagcaggcttctgagccccaagttgccttcaaaccaagccaggatccgcgcactcctgccggcccccagtaccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggaggggcccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccangctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 419460 - DNA, 4773 bp, Homo sapiens
  misc_feature (1942)..(1942): n is a, c, g, or t
agcggataagctccagccttcctgtggccacagcaggaccagagtggaccagcacaccccaggagagaggactggggtcccaggagtaggaggagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcacacacacggggagcccagaccctgagcaggcttctgagccccaagttgccttcaaaccaagccaggatccgcgcactcctgccggcccccagtaccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggaggggcccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccangctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggagagcccgggccacccggacagatgggaccagaaggtcctggaggccagcagggctcgccggggacccagggccgtgcagtccaggggcctgtgggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctcacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggggggaaattttctctccggggggggcgctggactttttgtagaaaagaagggggccccccctaggaggggagccgtctaataataagcaacgagcgggcgagggccgcgcgcgctttaaaaacagtggtggggcgggagagacaacacccgtcgtttgctgctgctcctttgtctggacgaaaggagacgaccacacctcctgggtggggggggagcacaaatgtggggagaacaccacccacacgaagagaagatttttaccccctcggggggagaaatacaatatccggcggggggtgatgtgggggggtgaccacacaccaggtgagtatatctgtcgtgcgcgaagaaaaactagtttgcctagaggggcattcttcataggaaaacttttcgcg

SEQ ID NO: 419461 - DNA, 4640 bp, Homo sapiens
acagacgtctcaggaaactgggggcaacctggggggagccccgtgggctgtgggaacccctgcccccggcttggaagctgcccacagtggcctggttgcagcctggcagatgaggggtacatcactactcagaataaacggccccctctgcacccacctgtctagatgagggtgacaggcactatcacagggcccccacctgacgccttcccacctggccatgcccccccagaactgtcatggagcccaggaggcgcctgtgtggagcacggggacctggcacgctgctgcccctagatctcagactcccatctaaggaccagacctgctgcctgtgcccagggaggggccctgacaccctctgtccccgtcagaacagggccccaagccactgcattgctccgtcctcacatgccctccctttcctcgcaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcacccagccaagcgaggcgggagtcatttcctgggagagtgtcccccaccctggctctgtgcaccccaccttgaggccctgcagcttcagccgcagtggggaaggggaggggctgggctgatggcgaatcgggttcaggagggcagcagtgccctgtggccgtctcagtagctctaaaacaggctcaacaacatgccccgcccctttctctgggcctcatctaagcctggccagggccctgtgggcccgcctctctctgcgcctcacgcaggcaacagatggttccactgctggcccaccagtcacctgcacgatggctcctccctcagaacagcactcccaccccggccccagcaccttcacatctgggcacaggcaggtccctgcctgcctcatcgtcccctctgtccccagcccaagaaggagttcagatcctgtgtgtgaatggccacccctcacccacccagccctgtgctgagttccttgtgcagggacattgctttgagacttggcaccatcagcccctggtccttagggtctcagagcaaggtcatccctcagcaggcttctggcctgtgcgctcctcagcacctctgcccaggtctctcccaaccatcacagacgctgtgtgagcctggacttcctgccttatccccactgtggcccaaacagcatgggggcaagctcagaacacacacctgggcttctgggccttgtggcccgtgggggtgatgtgggaacttctacttcctttccaaacaaatattcagtaactagtccactgttaccacttaggcagctaagcaagaaaggtgccagaaatgaagagggaagccatatcattgaggagagaatgaaaagtattaaaaaggaacaaagagagacccttgatattgacagaaggaaaacccaccaagatcaccagtgcagcattgcgtgcaccaaagcataccccaaagaggtgagcgcaaaacagcttcagggcaaacacttcatctatgattcaactgttccaggaactgaccagacctggagaccaaatagagagtcataggcagggtcagcaggatgggagagagcgcctgcacccacaggagccacagccctgactgaggccaggaagcagccccaaatgccagctcccactgcagcatgagaacagaaacagaccactgaaaattcccaaagtctgtggacaaatcagacgtcgaagaagtcacgtggcatcgagacagattttgcactgagggacaaggagagcatgtggccaaagtaggtgcaggtaaagcagcatctggggcagagttatagccttcagtgcaggtatcagacacagttgttgagagcagcagcccaagccagcccctccgtcctgcagggaggacacctaggtcacttggcttctgttggggagctgagttgcttcagattgtgtgaccagcaaaacagcttggttgctctcacttggtttctccagggcggggaattacatgtccccagctgaactgagaaggctctttgagcagtggagtgagcaggctttgtcatgaggcaggagtggggctagaatcaagcccagagcccacagggcatccagagccttccaaaggagcccctctcctggggctctccaatttgatgaagggactgggcactgggtggctgagaccacattggcagccaggaggaggcagcctggccggggggaaccagggtggctctaatccccaccaccccctcagctgccctacccccgccacgctggtgtgacaccagtgatgctcagcctcaaaaggggagtccggctgtcttcgggaaactgactttatgctggaggccaattaaaatggcacagcaaaggcagcggccagctggtgcccaggcagcttagggactggtccctgaggccccacccgccccagcctgtgcagtggagctgagtacgaatcaaaggtgaggatggcaagggagctgagagcagcctccggatgcaccaaaccggcctggctcctgtttgcaggaaggcagcctccccgagacccagccgacctgcacgtctcccatcagccccgactccaccgcatccctctgggtccttttaggagcccccagggactgagccggggctcacgctcctggccagagcgctgggtttctggcaatgcctcccctcctgcctttacggccacagctctcccctccagaggcccctctgtagtgggcctcggtcccctctccacccccagaggcagcacagcttcagccctacgcagtgtgggggctccgggaggaaatgcagggaggtgcttggtcttggcccagagctcatggccttaggtgctgcccccagtcacccccgtgcccatgcagccggggatgttcagctcaggccagccaccgaggtggtgtgacgcaaggctgatctgacgctcagctcaggccgctggggtcatgggggttgtgggaaggtcatggaatcacggggctcacgctggggtcacagggtggtgtggctgtgtggactgtaaggggcgtgcagccatgcgtatctgacctgccctccctaggtctgcaggcagtgccgagtggctctgcctgaggccccaagagcgaccttggaagctccaggccttcacagcccctctgagagccacctgcaaggtggggagctgggaagaacggctcagtgatgagctcagagggaggggtgggcacagcgcccaggaaggcgggtgcgtgcaggcctgggaggaatgtgtagcaggaggcagggggtgctgtgcccgcaggaccagcaggtgaggcgtgtccacccacaggatggctctggcccaggcagtgtcagaaatggaagctgaggaaacccaaccccagctgtagaggagcctgccccgatgccatctgcacctggggggcgacgtatggctgccagcctcttcatctaccaaggaccagggcagtggggacgggagagctgggacacgtggactcacaccagggcagatggtgggggaagccagtgtctgtagattcagtgcatttcttggggaagggcgtggaacatttggacttgagccccagcacagagacgatgtcataatacagccccccatcgtgatctgatggtaagtacagaactccttgcccagtggagaaacactctcctctcatgtgtggaatatccacacactaaccatgaactgggccataagaaaccttacattccaaaggatcctgctgttcagaactcactcactcactgatgaaactggaaaaacaaccaatgataacaagctaaagaatgcctctagaagctaaaagacacacccatgactccacagtaattcatgggttaaagagaaaaaaggaaacgtgaagatacttgtaaccaaataatgatggatgcagcgccacgtcagaatctctgtgctgcagctgcagtggtacctagagggcaatttatagctgtaaatacagtgctttgttttgttttcttgttttttgagacaaggtcttgctctgtcacccaggctggagtacagtggcatgatctcggctcaatgcaacctctgtgccaccctgggctcaagtggtcctcctgctccggtcttctgagtagcaggaaccacaggcgtgcgccaccacgcttggctaatgttttttgtatttttttaaatagagacagggtgttgccgtgttacccaggctggtcttgaacttctgagctcaaacgatccaccctccttggcctcccaaagtggtgggattacaggtgtgagtcacctcaccggcccttaaacacagtttttagggaagattccaactcaaacaattttaaatagtagaaaataaaccctgaagcagtgtgcattcattagtactgtgtttgcctgtatttaattaaaacctgattgccattggct

SEQ ID NO: 419462 - DNA, 847 bp, Homo sapiens
caattctcctgtctcagcctcccaagtagctgggattacaggtgcataccacatcacgcctggctaattttcttgtattttcagtagagatggggctttgccacgttggccaggctggtcttgaactgcagacctccagtgatccgcctgcctcggcctcccagtgctgggatcacaggcgtgagccgccgcgcctggtccatctttctagatacatgtagatatgtttatttttatatgaaactatgggaagggattctataatttcccagattctattatgctcataactgtttcaaaggtttaacagctgcaatttaaacatttcaaatgacaatacaaattcctctctcaaacagaaatggaaatgtccctttaaaagactgataatggtgaaaaacttcttcttaccattctacaggtaaaaagtatagtctagccagccaatgacactgaagatttggggaagcaatgtttttgatccctggccccagcccactcttccatccagctaatcctttagggctctactgtaccttccctagagctccgggccttcagtgatgccttctctctgatctcttcaaagatagaaatttctgtcatgctcatacgctggcttcccatgaaggttcatatgaattaccatctgctctaacaaactactgttaaattgtattttacataaaagttaaatctaattttatttcttctgaggaagctgaactaacttttgaccagaaaggggagagagtgagtggctgtatcactcatgatataattaagggtgaggggtaaaaggagtaaaaacaatcagacctcttccagaaggatttagaaccagtaa

SEQ ID NO: 419463 - DNA, 2303 bp, Homo sapiens
tggaatgcccgccagggcaagggtagggaggaggcggccgaaccgcgtcgctgggccgaaaggtgcgcgagcgctgcccgcgcggggaccacaaccaaagtcgcggccgccgcagccatgcgctgggtgtgggcgctgctgaagaatgcgtccctggcaggggcgcccaagtacatagagcacttcagcaagttctccccgtccccgctgtccatgaagcagtttctggacttcggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaaacacatcggcagcatcgaccccaactgcaacgtctctgaggtggtcaaagatgcctacgacatggctaagctcctgtgtgacaagtattacatggcctcacctgacctggagatccaggagatcaatgcagccaactccaaacagccgattcacatggtctacgtcccctcccacctctaccacatgctctttgagctcttcaagaatgccatgagggcgactgtggaaagccatgagtccagcctcattctcccacccatcaaggtcatggtggccttgggtgaggaagatctgtccatcaagatgagtgaccgaggtgggggtgttcccttgaggaagattgagcgactcttcagctacatgtactccacagcacccaccccccagcctggcaccgggggaacgccgctggctggctttggttatgggctccccatttcccgcctctacgccaagtacttccagggagacctgcagctcttctccatggaaggctttgggaccgatgctgtcatctatctcaaggccctgtccacggactcggtggagcgcctgcctgtctacaacaagtcagcctggcgccactaccagaccatccaggaggccggcgactggtgtgtgcccagcacggagcccaagaacacgtccacgtaccgcgtcagctaagggccgccgtgcatctgcacctgagaggacggactgccgcctctgggtccccccaccgtggtgcccctcaccatcctcctgggggagcagggggtgggttctccctgatgaccaggttctgtctctatggaagtcactgcggtgataggtctgtgatggtccctaagtgccagtccatctctgtggagacccctcggtggcctccctatctctgtgggcgatgcctgagggttagggatgtctccaccctgatggggtgtcccagagacattttcccatggcagtcctcctctctgagaccagggctgtcacttttctgccaggggtactgggtccccctcagcaccctccacagcacaggccttccaagtggatgtcccgttgccttattcccccagcccacaaaggcaccctggccttggtctgctgaagtgttaggaagagggtgggtgccctccagacctggggactgagtggggaaaggagttacacccgtgagtggggaatgaggctggtcctgcagcctctccctccgctcagggcttgaaggtcggtggcggagggggtggctctcacagggcccaactctaaagtggaagaaccttgttagaccgagagcttgccatccagccaagctgctcgaggccctgcagtggccttggcaatgtctgtgccacctcctgagccctcccagcatgtcctcacatgctcatgcccacccgctcctccacaagcctagtccatcctgcctgagctccagcccccagcccccactgtgcccagacatgtgtgctcagggtggctttctccctaggaccttctgtgtatatagttagttttataaccctgaatgcccccacccttcccctaagcacacaggggttaaagctgtgtgtccctcccagtggctgtggcagtgacagtgacacccacacccacagtaaagaggagactgaatgaga

SEQ ID NO: 419464 - DNA, 782 bp, Homo sapiens
tgggcaggggccccaggcaccgtgatgtggagtcaagccgcctatacctcccttggctgccccagggctgctaggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacagtgggtgccggccacagcggcggggagcgggcggtggagggggcggtgctggggcccagggccgggctgctgaggggacctagaccactcttcagaaccccacaaagggagtctttgaatagttactccagtaactatggagttaatggctccaacatggaaaaataaaatttttctttctcattgattttccatttcaaaacgttttgttttcagtgtttgcaaaatgtaaaattatgtcacatctttaaaagaatgtttaatttagtatttataaaaactctcattatgttcaaaaacaaaatgttg

SEQ ID NO: 419465 - DNA, 530 bp, Homo sapiens
ttgtggcaacagctggaaggggtccccaggagctctgacacagggttttccaactgcccaacatcacggggttggggagcagagcatccagagggctccgtgtattgttttgtagtatagggtctaacttctagaaagtcgggaataggcttctgagagttttggagtcaacaggcctgaatgcagaatgatcaaaagaagatggctattcctctcagagtggtgctggttttcggggccagcagtgcagtgaaaagcccaatttcccaatcctattttgaatatttccgctcctccacaagcctagtccatcctgcctgagctccagcccccagcccccactgtgcccagacatgtgtgctcagggtggctttctccctaggaccttctgtgtatatagttagttttataaccctgaatgcccccacccttcccctaagcacacaggggttaaagctgtgtgtccctcccagtggctgtggcagtgacagtgacacccacacccacagtaaagaggagactgaatgaga

SEQ ID NO: 419466 - DNA, 469 bp, Homo sapiens
tggaatgcccgccagggcaagggtagggaggaggcggccgaaccgcgtcgctgggccgaaaggtgcgcgagcgctgcccgcgcggggaccacaaccaaagtcgcggccgccgcagccatgcgctgggtgtgggcgctgctgaagaatgcgtccctggcaggggcgcccaagtacatagagcacttcagcaagttctccccgtccccgctgtccatgaagcagtttctggacttcggtacggagtgggcgggaggcggctggcagcggaggccggcggggcgctgggaggggcagccgggggctagggggacggaggagaagaaaggccccgagtgacagagaagggttgtttggaaaggtacaggcaggaaagagttaatggggaagcaggaaccggccggggcctctcgacggggctgctgatgggaatggggggcatttacaaggacggtcccgaggtttcttcgtg

SEQ ID NO: 419467 - DNA, 2639 bp, Homo sapiens
tggaatgcccgccagggcaagggtagggaggaggcggccgaaccgcgtcgctgggccgaaaggtgcgcgagcgctgcccgcgcggggaccacaaccaaagtcgcggccgccgcagccatgcgctgggtgtgggcgctgctgaagaatgcgtccctggcaggggcgcccaagtacatagagcacttcagcaagttctccccgtccccgctgtccatgaagcagtttctggacttcggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaaacacatcggcagcatcgaccccaactgcaacgtctctgaggtggtcaaagatgcctacgacatggctaagctcctgtgtgacaagtattacatggcctcacctgacctggagatccaggagatcaatgcagccaactccaaacagccgattcacatggtctacgtcccctcccacctctaccacatgctctttgagctcttcaagaatgccatgagggcgactgtggaaagccatgagtccagcctcattctcccacccatcaaggtcatggtggccttgggtgaggaagatctgtccatcaagatgagtgaccgaggtgggggtgttcccttgaggaagattgagcgactcttcagctacatgtactccacagcacccaccccccagcctggcaccgggggaacgccgctggctggctttggttatgggctccccatttcccgcctctacgccaagtacttccagggagacctgcagctcttctccatggaaggctttgggaccgatgctgtcatctatctcaaggccctgtccacggactcggtggagcgcctgcctgtctacaacaagtcagcctggcgccactaccagaccatccaggaggccggcgactggtgtgtgcccagcacggagcccaagaacacgtccacgtaccgcgtcagctaagggccgccgtgcatctgcacctgagaggacggactgccgcctctgggtccccccaccgtggtgcccctcaccatcctcctgggggagcagggggtgggttctccctgatgaccaggttctgtctctatggaagtcactgcggtgataggtctgtgatggtccctaagtgccagtccatctctgtggagacccctcggtggcctccctatctctgtgggcgatgcctgagggttagggatgtctccaccctgatggggtgtcccagagacattttcccatggcagtcctcctctctgagaccagggctgtcacttttctgccaggggtactgggtccccctcagcaccctccacagcacaggccttccaagtggatgtcccgttgccttattcccccagcccacaaaggcaccctggccttggtctgctgaagtgttaggaagagggtgggtgccctccagacctggggactgagtggggaaaggagttacacccgtgagtggggaatgaggctggtcctgcagcctctccctccgctcagggcttgaaggtcggtggcggagggggtggctctcacagggcccaactctaaagtggaagaaccttgttagaccgagagcttgccatccagccaagctgctcgaggccctgcagtggccttggcaatgtctgtgccacctcctgagccctcccagcatgtcctcacatgctcatgcccacccgctcctccacaagcctagtccatcctgcctgagctccagcccccagcccccactgtgcccagacatgtgtgctcagggtggctttctccctaggaccttctgtgtatatagttagttttataaccctgaatgcccccacccttcccctaagcacacaggggttaaagctgtgtgtccctcccagtggctgtggcagtgacagtgacacccacacccacagtaaagaggagactgaatgagactggcctggctgcatccctgggggaggggacccacacgtgcgcacgtacacacgcacactgcggtgccctgtgaccaccacatgacgcaccggggacgtccggcccagctcaggactgtgagtaaaacactgggcaaagccatctgttcagaacgccggatggcccagcacctggtgacagacctgttgtcccaccatactcagggcccagcagagtccggccaacccaacaactggagcagacagaaattctggtcactggcacatcataaggatttattgaaataaattgagaactgcctccccttcacatgcaggtgggcacccactagagct

SEQ ID NO: 419468 - DNA, 1857 bp, Homo sapiens
tggaatgcccgccagggcaagggtagggaggaggcggccgaaccgcgtcgctgggccgaaaggtgcgcgagcgctgcccgcgcggggaccacaaccaaagtcgcggccgccgcagccatgcgctgggtgtgggcgctgctgaagaatgcgtccctggcaggggcgcccaagtacatagagcacttcagcaagttctccccgtccccgctgtccatgaagcagtttctggacttcggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaaacacatcggcagcatcgaccccaactgcaacgtctctgaggtggtcaaagatgcctacgacatggctaagctcctgtgtgacaagtattacatggcctcacctgacctggagatccaggagatcaatgcagccaactccaaacagccgattcacatggtctacgtcccctcccacctctaccacatgctctttgagctcttcaagaatgccatgagggcgactgtggaaagccatgagtccagcctcattctcccacccatcaaggtcatggtggccttgggtgaggaagatctgtccatcaagatgagtgaccgaggtgggggtgttcccttgaggaagattgagcgactcttcagctacatgtactccacagcacccaccccccagcctggcaccgggggaacgccgctggctggctttggttatgggctccccatttcccgcctctacgccaagtacttccagggagacctgcagctcttctccatggaaggctttgggaccgatgctgtcatctatctcaaggccctgtccacggactcggtggagcgcctgcctgtctacaacaagtcagcctggcgccactaccagaccatccaggaggccggcgactggtgtgtgcccagcacggagcccaagaacacgtccacgtaccgcgtcagctaagggccgccgtgcatctgcacctgagaggacggactgccgcctctgggtccccccaccgtggtgcccctcaccatccacccttcccctaagcacacaggggttaaagctgtgtgtccctcccagtggctgtggcagtgacagtgacacccacacccacagtaaagaggagactgaatgagactggcctggctgcatccctgggggaggggacccacacgtgcgcacgtacacacgcacactgcggtgccctgtgaccaccacatgacgcaccggggacgtccggcccagctcaggactgtgagtaaaacactgggcaaagccatctgttcagaacgccggatggcccagcacctggtgacagacctgttgtcccaccatactcagggcccagcagagtccggccaacccaacaactggagcagacagaaattctggtcactggcacatcataaggatttattgaaataaattgagaactgcctccccttcacatgcaggtgggcacccactagagct

SEQ ID NO: 419469 - DNA, 2227 bp, Homo sapiens
  misc_feature (1)..(1): n is a, c, g, or t
  misc_feature (17)..(17): n is a, c, g, or t
  misc_feature (19)..(19): n is a, c, g, or t
  misc_feature (21)..(21): n is a, c, g, or t
ncgtccctggcagggcnanangtgacatagagcacttcatcaagttctccccgtccccgctgctgaagaatgcgtccctggcaggggcgcccaagtacatagagcacttcagcaagttctccccgtccccgctgtccatgaagcagtttctggacttcggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaaacacatcggcagcatcgaccccaactgcaacgtctctgaggtggtcaaagatgcctacgacatggctaagctcctgtgtgacaagtattacatggcctcacctgacctggagatccaggagatcaatgcagccaactccaaacagccgattcacatggtctacgtcccctcccacctctaccacatgctctttgagctcttcaagaatgccatgagggcgactgtggaaagccatgagtccagcctcattctcccacccatcaaggtcatggtggccttgggtgaggaagatctgtccatcaagatgagtgaccgaggtgggggtgttcccttgaggaagattgagcgactcttcagctacatgtactccacagcacccaccccccagcctggcaccgggggaacgccgctggctggctttggttatgggctccccatttcccgcctctacgccaagtacttccagggagacctgcagctcttctccatggaaggctttgggaccgatgctgtcatctatctcaaggccctgtccacggactcggtggagcgcctgcctgtctacaacaagtcagcctggcgccactaccagaccatccaggaggccggcgactggtgtgtgcccagcacggagcccaagaacacgtccacgtaccgcgtcagctaagggccgccgtgcatctgcacctgagaggacggactgccgcctctgggtccccccaccgtggtgcccctcaccatcctcctgggggagcagggggtgggttctccctgatgaccaggttctgtctctatggaagtcactgcggtgataggtctgtgatggtccctaagtgccagtccatctctgtggagacccctcggtggcctccctatctctgtgggcgatgcctgagggttagggatgtctccaccctgatggggtgtcccagagacattttcccatggcagtcctcctctctgagaccagggctgtcacttttctgccaggggtactgggtccccctcagcaccctccacagcacaggccttccaagtggatgtcccgttgccttattcccccagcccacaaaggcaccctggccttggtctgctgaagtgttaggaagagggtgggtgccctccagacctggggactgagtggggaaaggagttacacccgtgagtggggaatgaggctggtcctgcagcctctccctccgctcagggcttgaaggtcggtggcggagggggtggctctcacagggcccaactctaaagtggaagaaccttgttagaccgagagcttgccatccagccaagctgctcgaggccctgcagtggccttggcaatgtctgtgccacctcctgagccctcccagcatgtcctcacatgctcatgcccacccgctcctccacaagcctagtccatcctgcctgagctccagcccccagcccccactgtgcccagacatgtgtgctcagggtggctttctccctaggaccttctgtgtatatagttagttttataaccctgaatgcccccacccttcccctaagcacacaggggttaaagctgtgtgtccctcccagtggctgtggcagtgacagtgacacccacacccacagtaaagaggagactgaatgaga

SEQ ID NO: 419470 - DNA, 1159 bp, Homo sapiens
tggaatgcccgccagggcaagggtagggaggaggcggccgaaccgcgtcgctgggccgaaaggtgcgcgagcgctgcccgcgcggggaccacaaccaaagtcgcggccgccgcagccatgcgctgggtgtgggcgctgctgaagaatgcgtccctggcaggggcgcccaagtacatagagcacttcagcaagttctccccgtccccgctgtccatgaagcagtttctggacttcggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaaacacatcggcagcatcgaccccaactgcaacgtctctgaggtggtcaaagatgcctacgacatggctaagctcctgtgtgacaagtattacatggcctcacctgacctggagatccaggagatcaatgcagccaactccaaacagccgattcacatggtctacgtcccctcccacctctaccacatgctctttgagctcttcaagaatgccatgagggcgactgtggaaagccatgagtccagcctcattctcccacccatcaaggtcatggtggccttgggtgaggaagatctgtccatcaagatgagtgaccgaggtgggggtgttcccttgaggaagattgagcgactcttcagctacatgtactccacagcacccacctcggtcactcatcttgatggacagatcttcctcacccaaggccaccatgaccttgatgggtgggagaatgaggctggactcatggctttccacagtcgtcctt

SEQ ID NO: 419471 - DNA, 2142 bp, Homo sapiens
tgggcaggggccccaggcaccgtgatgtggagtcaagccgcctatacctcccttggctgccccagggctgctaggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaaacacatcggcagcatcgaccccaactgcaacgtctctgaggtggtcaaagatgcctacgacatggctaagctcctgtgtgacaagtattacatggcctcacctgacctggagatccaggagatcaatgcagccaactccaaacagccgattcacatggtctacgtcccctcccacctctaccacatgctctttgagctcttcaagaatgccatgagggcgactgtggaaagccatgagtccagcctcattctcccacccatcaaggtcatggtggccttgggtgaggaagatctgtccatcaagatgagtgaccgaggtgggggtgttcccttgaggaagattgagcgactcttcagctacatgtactccacagcacccaccccccagcctggcaccgggggaacgccgctggctggctttggttatgggctccccatttcccgcctctacgccaagtacttccagggagacctgcagctcttctccatggaaggctttgggaccgatgctgtcatctatctcaaggccctgtccacggactcggtggagcgcctgcctgtctacaacaagtcagcctggcgccactaccagaccatccaggaggccggcgactggtgtgtgcccagcacggagcccaagaacacgtccacgtaccgcgtcagctaagggccgccgtgcatctgcacctgagaggacggactgccgcctctgggtccccccaccgtggtgcccctcaccatcctcctgggggagcagggggtgggttctccctgatgaccaggttctgtctctatggaagtcactgcggtgataggtctgtgatggtccctaagtgccagtccatctctgtggagacccctcggtggcctccctatctctgtgggcgatgcctgagggttagggatgtctccaccctgatggggtgtcccagagacattttcccatggcagtcctcctctctgagaccagggctgtcacttttctgccaggggtactgggtccccctcagcaccctccacagcacaggccttccaagtggatgtcccgttgccttattcccccagcccacaaaggcaccctggccttggtctgctgaagtgttaggaagagggtgggtgccctccagacctggggactgagtggggaaaggagttacacccgtgagtggggaatgaggctggtcctgcagcctctccctccgctcagggcttgaaggtcggtggcggagggggtggctctcacagggcccaactctaaagtggaagaaccttgttagaccgagagcttgccatccagccaagctgctcgaggccctgcagtggccttggcaatgtctgtgccacctcctgagccctcccagcatgtcctcacatgctcatgcccacccgctcctccacaagcctagtccatcctgcctgagctccagcccccagcccccactgtgcccagacatgtgtgctcagggtggctttctccctaggaccttctgtgtatatagttagttttataaccctgaatgcccccacccttcccctaagcacacaggggttaaagctgtgtgtccctcccagtggctgtggcagtgacagtgacacccacacccacagtaaagaggagactgaatgaga

SEQ ID NO: 419472 - DNA, 1841 bp, Homo sapiens
tagagcatccccggggcccttaaccctgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaaacacatcggcagcatcgaccccaactgcaacgtctctgaggtggtcaaagatgcctacgacatggctaagctcctgtgtgacaagtattacatggcctcacctgacctggagatccaggagatcaatgcagccaactccaaacagccgattcacatggtctacgtcccctcccacctctaccacatgctctttgagctcttcaagaatgccatgagggcgactgtggaaagccatgagtccagcctcattctcccacccatcaaggtcatggtggccttgggtgaggaagatctgtccatcaagatgagtgaccgaggtgggggtgttcccttgaggaagattgagcgactcttcagctacatgtactccacagcacccaccccccagcctggcaccgggggaacgccgctggctggctttggttatgggctccccatttcccgcctctacgccaagtacttccagggagacctgcagctcttctccatggaaggctttgggaccgatgctgtcatctatctcaaggccctgtccacggactcggtggagcgcctgcctgtctacaacaagtcagcctggcgccactaccagaccatccaggaggccggcgactggtgtgtgcccagcacggagcccaagaacacgtccacgtaccgcgtcagctaagggccgccgtgcatctgcacctgagaggacggactgccgcctctgggtccccccaccgtggtgcccctcaccatcctcctgggggagcagggggtgggttctccctgatgaccaggttctgtctctatggaagtcactgcggtgataggtctgtgatggtccctaagtgccagtccatctctgtggagacccctcggtggcctccctatctctgtgggcgatgcctgagggttagggatgtctccaccctgatggggtgtcccagagacattttcccatggcagtcctcctctctgagaccagggctgtcacttttctgccaggggtactgggtccccctcagcaccctccacagcacaggccttccaagtggatgtcccgttgccttattcccccagcccacaaaggcaccctggccttggtctgctgaagtgttaggaagagggtgggtgccctccagacctggggactgagtggggaaaggagttacacccgtgagtggggaatgaggctggtcctgcagcctctccctccgctcagggcttgaaggtcggtggcggagggggtggctctcacagggcccaactctaaagtggaagaaccttgttagaccgagagcttgccatccagccaagctgctcgaggccctgcagtggccttggcaatgtctgtgccacctcctgagccctcccagcatgtcctcacatgctcatgcccacccgctcctccacaagcctagtccatcctgcctgagctccagcccccagcccccactgtgcccagacatgtgtgctcagggtggctttctccctaggaccttctgtgtatatagttagttttataaccctgaatgcccccacccttcccctaagcacacaggggttaaagctgtgtgtccctcccagtggctgtggcagtgacagtgacacccacacccacagtaaagaggagactgaatgaga

SEQ ID NO: 419473 - DNA, 943 bp, Homo sapiens
tggaatgcccgccagggcaagggtagggaggaggcggccgaaccgcgtcgctgggccgaaaggtgcgcgagcgctgcccgcgcggggaccacaaccaaagtcgcggccgccgcagccatgcgctgggtgtgggcgctgctgaagaatgcgtccctggcaggggcgcccaagtacatagagcacttcagcaagttctccccgtccccgctgtccatgaagcagtttctggacttcggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacagtgggtgccggccacagcggcggggagcgggcggtggagggggcggtgctggggcccagggccgggctgctgaggggacctagaccactcttcagaaccccacaaagggagtctttgaatagttactccagtaactatggagttaatggctccaacatggaaaaataaaatttttctttctcattgattttccatttcaaaacgttttgttttcagtgtttgcaaaatgtaaaattatgtcacatctttaaaagaatgtttaatttagtatttataaaaactctcattatgttcaaaaacaaaatgttg

SEQ ID NO: 419474 - DNA, 1156 bp, Homo sapiens
tggaatgcccgccagggcaagggtagggaggaggcggccgaaccgcgtcgctgggccgaaaggtgcgcgagcgctgcccgcgcggggaccacaaccaaagtcgcggccgccgcagccatgcgctgggtgtgggcgctgctgaagaatgcgtccctggcaggggcgcccaagtacatagagcacttcagcaagttctccccgtccccgctgtccatgaagcagtttctggacttcggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacagtgggtgccggccacagcggcggggagcgggcggtggagggggcggtgctggggcccagggccgggctgctgaggggacctagaccactcttcagaaccccacaaagggagtctttgaatagttactccagtaactatggagttaatggctccaacatggaaaaataaaatttttctttctcattgaaaaaaaaaaaaaaaaaaaaaaaaaaaaaaaattgtggggcgggcctctggcgccctatcagaaaaagcttctaaaagacaattccggtggggcgcggggcgacaaggtagggaaaggacgaacatgggggccaatatcgcgtggtccccaaagagaaatccggcgccaaggacataggggcgggggttcctcccacaaataaaaaaaacgcgcgggcggggaacacgcagcggcgtgtcggagaacaaactcccgaagagggagtgtccaggggggcccataccggggctctcatcacaggagggagtctcacacgggaggcccgaaattctcaa

SEQ ID NO: 419475 - DNA, 1735 bp, Homo sapiens
cccagctcaagggaggctggggatttagtctctcgctgggcagccatgtactcagaactttgtgggagggggtgcctcctttgggtaaggtggttgagcagtgacctcctgacggtttcctgacccttggtcttgacttgccctgtagcagccaactccaaacagccgattcacatggtctacgtcccctcccacctctaccacatgctctttgagctcttcaaggtgaggaggctgggagccggtgctttgcggggagcgtgagtagggctggcttctcccatgcatctcttacctctgcccctccgcagaatgccatgagggcgactgtggaaagccatgagtccagcctcattctcccacccatcaaggtcatggtggccttgggtgaggaagatctgtccatcaagatgagtgaccgaggtgggggtgttcccttgaggaagattgagcgactcttcagctacatgtactccacagcacccaccccccagcctggcaccgggggaacgccgctggctggctttggttatgggctccccatttcccgcctctacgccaagtacttccagggagacctgcagctcttctccatggaaggctttgggaccgatgctgtcatctatctcaaggccctgtccacggactcggtggagcgcctgcctgtctacaacaagtcagcctggcgccactaccagaccatccaggaggccggcgactggtgtgtgcccagcacggagcccaagaacacgtccacgtaccgcgtcagctaagggccgccgtgcatctgcacctgagaggacggactgccgcctctgggtccccccaccgtggtgcccctcaccatcctcctgggggagcagggggtgggttctccctgatgaccaggttctgtctctatggaagtcactgcggtgataggtctgtgatggtccctaagtgccagtccatctctgtggagacccctcggtggcctccctatctctgtgggcgatgcctgagggttagggatgtctccaccctgatggggtgtcccagagacattttcccatggcagtcctcctctctgagaccagggctgtcacttttctgccaggggtactgggtccccctcagcaccctccacagcacaggccttccaagtggatgtcccgttgccttattcccccagcccacaaaggcaccctggccttggtctgctgaagtgttaggaagagggtgggtgccctccagacctggggactgagtggggaaaggagttacacccgtgagtggggaatgaggctggtcctgcagcctctccctccgctcagggcttgaaggtcggtggcggagggggtggctctcacagggcccaactctaaagtggaagaaccttgttagaccgagagcttgccatccagccaagctgctcgaggccctgcagtggccttggcaatgtctgtgccacctcctgagccctcccagcatgtcctcacatgctcatgcccacccgctcctccacaagcctagtccatcctgcctgagctccagcccccagcccccactgtgcccagacatgtgtgctcagggtggctttctccctaggaccttctgtgtatatagttagttttataaccctgaatgcccccacccttcccctaagcacacaggggttaaagctgtgtgtccctcccagtggctgtggcagtgacagtgacacccacacccacagtaaagaggagactgaatgaga

SEQ ID NO: 419476 - DNA, 1304 bp, Homo sapiens
agtgtcgtttgttcaacgattaaagtcctacgtgacctaagttcagagccaggcctggctctgaacttaggcgggggaacgccgctggctggctttggttatgggctccccatttcccgcctctacgccaagtacttccagggagacctgcagctcttctccatggaaggctttgggaccgatgctgtcatctatctcaaggccctgtccacggactcggtggagcgcctgcctgtctacaacaagtcagcctggcgccactaccagaccatccaggaggccggcgactggtgtgtgcccagcacggagcccaagaacacgtccacgtaccgcgtcagctaagggccgccgtgcatctgcacctgagaggacggactgccgcctctgggtccccccaccgtggtgcccctcaccatcctcctgggggagcagggggtgggttctccctgatgaccaggttctgtctctatggaagtcactgcggtgataggtctgtgatggtccctaagtgccagtccatctctgtggagacccctcggtggcctccctatctctgtgggcgatgcctgagggttagggatgtctccaccctgatggggtgtcccagagacattttcccatggcagtcctcctctctgagaccagggctgtcacttttctgccaggggtactgggtccccctcagcaccctccacagcacaggccttccaagtggatgtcccgttgccttattcccccagcccacaaaggcaccctggccttggtctgctgaagtgttaggaagagggtgggtgccctccagacctggggactgagtggggaaaggagttacacccgtgagtggggaatgaggctggtcctgcagcctctccctccgctcagggcttgaaggtcggtggcggagggggtggctctcacagggcccaactctaaagtggaagaaccttgttagaccgagagcttgccatccagccaagctgctcgaggccctgcagtggccttggcaatgtctgtgccacctcctgagccctcccagcatgtcctcacatgctcatgcccacccgctcctccacaagcctagtccatcctgcctgagctccagcccccagcccccactgtgcccagacatgtgtgctcagggtggctttctccctaggaccttctgtgtatatagttagttttataaccctgaatgcccccacccttcccctaagcacacaggggttaaagctgtgtgtccctcccagtggctgtggcagtgacagtgacacccacacccacagtaaagaggagactgaatgaga

SEQ ID NO: 419477 - DNA, 1389 bp, Homo sapiens
gacacctaggtcttgccattcagttcagaggagaagactgaggcccggagtccgtgacttgctcagggtcacacagcccagcctcctccccctccctctccctcccttagagggagctgcttgcttgaatgggcaggagcgggacacaggagggaccacccttttgtggtctttccaggcccccgtgtctggcagctgggccgccctggagctggggtggggtggtctgctgaggagtggacaaggcacagggaggtgggaggggctgaccctgacactccccagggccctgtccacggactcggtggagcgcctgcctgtctacaacaagtcagcctggcgccactaccagaccatccaggaggccggcgactggtgtgtgcccagcacggagcccaagaacacgtccacgtaccgcgtcagctaagggccgccgtgcatctgcacctgagaggacggactgccgcctctgggtccccccaccgtggtgcccctcaccatcctcctgggggagcagggggtgggttctccctgatgaccaggttctgtctctatggaagtcactgcggtgataggtctgtgatggtccctaagtgccagtccatctctgtggagacccctcggtggcctccctatctctgtgggcgatgcctgagggttagggatgtctccaccctgatggggtgtcccagagacattttcccatggcagtcctcctctctgagaccagggctgtcacttttctgccaggggtactgggtccccctcagcaccctccacagcacaggccttccaagtggatgtcccgttgccttattcccccagcccacaaaggcaccctggccttggtctgctgaagtgttaggaagagggtgggtgccctccagacctggggactgagtggggaaaggagttacacccgtgagtggggaatgaggctggtcctgcagcctctccctccgctcagggcttgaaggtcggtggcggagggggtggctctcacagggcccaactctaaagtggaagaaccttgttagaccgagagcttgccatccagccaagctgctcgaggccctgcagtggccttggcaatgtctgtgccacctcctgagccctcccagcatgtcctcacatgctcatgcccacccgctcctccacaagcctagtccatcctgcctgagctccagcccccagcccccactgtgcccagacatgtgtgctcagggtggctttctccctaggaccttctgtgtatatagttagttttataaccctgaatgcccccacccttcccctaagcacacaggggttaaagctgtgtgtccctcccagtggctgtggcagtgacagtgacacccacacccacagtaaagaggagactgaatgaga

SEQ ID NO: 419478 - DNA, 768 bp, Homo sapiens
tggaatgcccgccagggcaagggtagggaggaggcggccgaaccgcgtcgctgggccgaaaggtgcgcgagcgctgcccgcgcggggaccacaaccaaagtcgcggccgccgcagccatgcgctgggtgtgggcgctgctgaagaatgcgtccctggcaggggcgcccaagtacatagagcacttcagcaagttctccccgtccccgctgtccatgaagcagtttctggacttcggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccacacccttcccctaagcacacaggggttaaagctgtgtgtccctcccagtggctgtggcagtgacagtgacacccacacccacagtaaagaggagactgaatgaga

SEQ ID NO: 419479 - DNA, 769 bp, Homo sapiens
  misc_feature (1)..(1): n is a, c, g, or t
  misc_feature (17)..(17): n is a, c, g, or t
  misc_feature (19)..(19): n is a, c, g, or t
  misc_feature (21)..(21): n is a, c, g, or t
ncgtccctggcagggcnanangtgacatagagcacttcatcaagttctccccgtccccgctgctgaagaatgcgtccctggcaggggcgcccaagtacatagagcacttcagcaagttctccccgtccccgctgtccatgaagcagtttctggacttcggatccagcaatgcctgtgagaaaacctccttcaccttcctcaggcaggagctgcctgtgcgcctggccaacatcatgaaagagatcaacctgcttcccgaccgagtgctgagcacagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacagtgggtgccggccacagcggcggggagcgggcggtggagggggcggtgctggggcccagggccgggctgctgaggggacctagaccactcttcagaaccccacaaagggagtctttgaatagttactccagtaactatggagttaatggctccaacatggaaaaataaaatttttctttctcattgattttccatttcaaaacgttttgttttcagtgtttgcaaaatgtaaaattatgtcacatctttaaaagaatgtttaatttagtatttataaaaactctcattatgttcaaaaacaaaatgttg

SEQ ID NO: 419480 - DNA, 2354 bp, Homo sapiens
atgacaaaattaccctgaagaaataaccttattatgtgttaaattgtattaaatgcatttaacatttggatgctaaatgataatgaaaattgctaaaggttctttaatatggttcaaatctataagacttttttcttttagtaatactcagagggtcattctgctgcttgttatgaatcatagattacattcatgtcagattgatcaatatgtatgttttatgatttaacagcaaaaacctcttcaaacggaaaatttgaaagaaaggtttcaatagaaaaattatatatatatttatacatatatatgtgtgtgtgttactctcacagttcaactactgttgaactcaatcttttaatttatagttatacgtaggctatttatgtgtccaattgtatacctagaatacttacttaaaacttagtttacaactctttttaagatgagaactaaggcaattttgatatgattcatggtctattctttaaaaaaagatttcatttatgatagtatttgtaatgtttctgctggaaatcagaggcacgttccaagaggaaaatgtatataggagtacttttaaagaatatgtcactttgtaaattacatatcatgaaactaagcttttgacaagatacttaaaacctacagctgtaaaatacaggtttaaatggtgttcgtaatgctgagtgcatctgccagcccttttttattattaagtagaagattgtatctgtgccccttttttcgtagtggaaggtatatagccgagtataaaatggttttcttttgcattatctgtattcaaaaaacagggtagttatattaaagcttaccaaattgatggtgaatttatcagattaacctttttgtggtgcagatggttctaagtatcaggtgacagggtattctactctttctagtcaattaaaattgataatgcagcatgattcataaactaaccagctgtgcctccttttattttgaggaccctgtagtcactataataaatttctaagccaaatttttcaaacaagatagttcttatagaaggagaaataataaatatgtgtgtgttgatgcatgcacacagaatgacctgtgaaaggaaacttaaattttgccggtaaaacaaacatatctctacagactgtgattatacttcataagcatttaaatacagttttatttatttccttaaatatattacttgggtaattaattttagatttgattgcaaagagcactgtatagcagttgggaccagctcttggcttggcttggcttggcttattgttaagagtttattggatcaagactaacaaataactttgtgatgaaaattcttcaaaaatatagctactcttttcaagtataccatttaaaatatttcatcaggcagagccctgaccaggaaaaaaaaaaaaaagaaagaaagaaaagaaaaaaataaataaaatgctccaaaaagtgttttcagtagtcttcactggcccttgtgggaggaaaaatacttttttaacttgcttttctaagatttgttatatttaaatccaagagaaactatgccgaaaaaaagtgttataaagaggaatgcatgtagcattaatgcaaatatcaagaaaatacttgaaagagtccttttcatttatttaattaaatttggtgttttattttgtctgaatctgaatttctcctatttaatctatgcaattatgcttgttttatatttataagcacttgactcactgggtgtggtctttttactgtgttttatttcaaaacgttgttttaagtgatagtgtccttaaattttagtgtcatttggtcaacttactggtaacaccagaacaagaaagcaaaaaagtaataaattctgctggcacagaactaacatatcatttggtaactgtaaaacctatttgcagttaaaggttgatttattggataagggactaaaagaagcatatattacctttgcctttatattttttcttcttttaagaaggagcattatggaaaaataaatataaagtcttagtgaatttttgttatggttctcaattcagcaatctactggctgcttgcgaaactgtgaaatcaaattgttcttaacctttattcagtttagtttatagcattactgttttatgaaatgtgacattttaggagccaatataatagagctctaaaaggatagtatatctttaaattctgactggggagtaagaagagaagatattcttaccctactaaataaaccaacttttgagtagtatgcaatattatgaaatgttacaacactatattaaaaataataaaatattttaaaattgcatttaaaaaaatgtgtccat

SEQ ID NO: 419481 - DNA, 5891 bp, Homo sapiens
ggacgagtcgagcctcctgcggcgccgcgggctccagaaggagctgagcctgccacgccgaggacgtggctgccgcagcgggaaccgcaagagcttggtggtaggaacgccctccccgaccctctcccggcccctgtcgccattgtcggtcccaacggcaggcagcagccccttggatagtcctcggaatttctcggctgcctctgccctaaatttcccctttgcccggagggcagacggcagaagatggtccctcgcgtctctcccatcttccggctatggaaccaacacacccagctccaccctctcgtcaagctcatcctcccgggaacgtctccaccagcttcccttccagccgacgccggacgagctgcacttcctgtccaagcacttccgcagctcagagaatgtgcttgatgaggaaggcggccggtcaccccgcctccgaccccgctctcgcagtctcagcccgggccgtgcaacggggaccttcgacaatgagattgtcatgatgaatcacgtgtaccgggagaggttccccaaggccacagcacagatggagggccgtctgcaggagttcctgacggcctacgcgcccggcgcccggctggcgctggctgatggcgtcttgggcttcatccaccaccagatcgtcgagctggcccgagactgcttggccaagtctggcgagaacctcgtcacctcccgctacttcctagagatgcaggagaagctggagcggcttctgcaggatgcccatgagcgttcggacagtgaggaggtcagcttcatcgtccagcttgtccggaaactgctgatcatcatctcacggccagctcggctgctggagtgtctggagtttgaccctgaggaattttaccacctgctggaggcggctgagggccatgcgcgggagggccaaggcattaagactgaccttccacagtacatcattgggcagctgggcctggccaaggaccccctggaggagatggtgccactgagtcacctcgaagaagaacagcccccagcacctgagtccccagagagccgcgccctggtcggccagtcacggaggaagccatgcgaaagcgactttgagaccatcaaactcattagcaacggagcctatggggccgtctacctggtgcggcaccgtgacacacggcagcgctttgccatcaagaagatcaacaaacagaacttgatcctgcgtaaccagatccagcaggtctttgtggagcgtgacattctcacctttgccgagaacccctttgtggtcagcatgttctgctcctttgagacccggcgccacctatgtatggtcatggaatacgtggaaggcggcgactgcgccacgctcctgaagaacatgggcccgctgcccgtggacatggcccgcctgtacttcgccgagacggtgttggcgctggagtacctgcataactatggcatcgtgcaccgtgacctcaaaccagacaatctgctcatcacctcgcttggccacatcaagctcacggacttcggcctgtccaagatcggcctcatgagcatggccaccaacctctatgagggccacatcgagaaggacgcccgagagttcatcgacaagcaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcgatgagatcatgtggccagagggagatgaggcccttccagcagacgcccaggacctcatcaccaggttgctccggcagagcccgctggaccgtctgggcactggtggcacccacgaagtgaagcagcacccctttttcctggccctggactgggcagggcttctccgacacaaagccgagttcgtgccccagctcgaagccgaggatgataccagctactttgacacacgttcggaacgttaccgccatctgggctccgaggacgacgagaccaatgatgaagaatcgtccacagagatcccccagttctcctcctgctcccaccggttcagcaaggtctacagcagctctgagttcctggccgtccagcccactcctaccttcgctgaaaggagcttcagtgaagaccgggaggaggggtgggagcgcagcgaagtggactatggccgccggctgagtgctgacatccggctgaggtcctggacatcctctggatcctcctgtcagtcatcttcgtcccagcccgagcggggtcccagcccatctctcctgaataccatcagcctggacacaatgcccaagtttgccttctcatcagaggatgagggggtaggcccaggccctgcaggccccaagaggcccgtcttcattctaggggagcctgaccccccaccagcggccaccccagtgatgcccaagccctcgagcctttctgccgacacagctgctctcagccacgcccgcctacggagcaatagcatcggcgcccgacactccacaccaaggcctctggatgccagccggggccgccgccttgggggcccaagagacccagcccctgagaagtccagagcctcctccagcggtggcagtggtggcggcagtgggggccgcgtgcccaagtcagcctctgtctctgccctgtccctcatcatcacggcagatgatggcagcggcggccccctcatgagccccctttccccgcgctctctgtcctcgaacccgtcgtcccgtgactcttcgccgagccgagacccgtcccccgtgtgtggcagcctgcggccccccatcgttatccacagctctggcaagaagtacggcttcagcctgcgggcgatccgcgtctacatgggtgatagcgacgtctacactgtgcaccacgtcgtctggagtgtggaggacggaagccccgcccaggaggcgggcctgcgggctggggacctcatcacccacatcaacggggagtcagtgctggggctggtgcacatggacgtcgtggagctgctgctgaagagcggcaacaagatatccctgcggaccacagccctggagaacacctccatcaaggtgggccccgcccggaagaatgtggccaagggccgcatggcacgcaggagcaagaggagccgtcggcgggagacccaggatcggcggaagtcacttttcaagaagatctccaagcagacctccgtgctgcacaccagccgcagcttctcctccggactccaccactcactgtcatccagtgagagcctccccggctcgcccacccacagcctctcccccagccccaccactccctgccgaagcccagcccctgatgtcccagcagataccactgcatccccacccagcgcatccccgagctccagcagccccgcctccccagctgctgctggccacacccgccccagctccctgcacggcctggctgccaagcttgggccaccccgccccaagactggccgccgcaagtccaccagcagcatcccgccctccccgctggcctgcccgcccatctccgcgcccccaccccgctcgccctcgcccctgcccgggcacccgcccgcacctgcccgatccccgcggctgcgccggggccagtcagctgacaagctgggcacaggggagcggctggatggggaggcggggcggcgcactcgtgggccagaggccgagctcgtggtcatgcggcggctgcacctgtccgagcgccgagactccttcaagaagcaggaggccgtgcaggaggttagcttcgatgagccgcaggaggaggccactgggctgcccacctcagtgccacagatcgccgtggagggcgaggaagccgtgccagtagctctcgggcccaccggaagagactgatcccctgccaggtctctccctggcatcaaagttacgcgttttcttgtgcaatgttttttccgtaaagtcatgcctggatggggactgagccaccagcctgacacccagaaggcgagaagccatctcggtccttgctggaaggtggagacatcgcttgtgttctggtgtcaatcaggggctggatggggcaagaatgggggacaagggtggctttgtaaatagcagcaaatccctgcaactaatttattactttttttttcttttttttttttttttttgagacagagtctcactctgttgcccgggctggagtgcagcggcgtgatctcagctcactgcaacctccgcctcccaagttcaagcgattgtcctgcctcagcttcccaagtggctgggattacaggcgcccaccactatgcccagctaattttttgtatttttagtacagacggggtttcaccatgttggtcaggctggtctcgaactcctgacctcatgatttgcctgcctttgcctcccaaagtgctgggattacaggcgtgagccactgggcccagcctaatttattactttttataagcgatagccgtactgagccgccccctgaaggcggctgccaggtcttgccccaggcacctgggactctgtttgcaggccctgccctctgggctgagaaggatgcactttggacaagtcatctgtgtttgtgttttccagtttttctgtactttttaagtgttttgtgttacctggtctcattcccctccccacacctacccatttgaggggatggagttgaagtcacctggtcacctgtaccggcccagttcggctacaacctggagtgtccgtaaacaattcctctcacccacaaaacaatgtaatcccagcgatggactggattctgaaggccacttcccaccatcatagctgccatgcccaggcagtgcctgctctatatatagagtctgcctccaatcctgctggcttcagcctggagaagggatatgggagctggagctttgatggatgaataggtgttcaccggatctgggcagaggggtcatccgctccccaggtgggcactgataaaggaaggtacaggcctcacctggaactgccaaggcagcctccagaaatgctcggctgtctcggggcacgctccagtatgccagtcctgcgggattacgtccagctacttccagaaacactcagtgtcccctcccctcaggctctgccttggcctggccttgtccagtctaccctggacaagatgccgtgtgtttgaggcccagcagagtaagcccttggccgtgatgtgtctgaaacacctgttaggggttccctccatatgtcagagcctctctgggatgaagttcaagccagaaaacccagtcgaggctcaagtttgaatttcagcttcactgtgtggctctgggaaaatggctttcccactctgtgcctcagtttccttgtgtttacaagactaatcccattgactgtttattaagcacctactgtgtgccaagcgcttttacgtggcttctccctcagccagccttgagaaggctggaggtggtgtcatcacctccattttacagacaaagcagctgagaccccagcgaggggcggagacctgtcccacgatcacccagcaggagtcgtggcagaacggagcatcagccagaccctgttgtgggcgttgtcatcaagggagcttgaatggagggtctggtgtcagatacagccgactccagccccagctcatcccccatgatgctgtgtgacccactgggcactctggtgagggagctttccagacatcaacagcccactctgcttccctttctgagtcccctgtccagcactgcctagtgttggagggtagaccaaggctgtgcatgattcaccccctccttccatcctggagctggcagtgaataaaagcccgtatttacaaaga

SEQ ID NO: 419482 - DNA, 5607 bp, Homo sapiens
cagccccggcccctccctgggctggtgtggaggcccaagttgtggctcctccttcaccccagccctgaccctgcctgagcctagcctctgattcttgtccctcaaccctggctcagatcccccaacatcctcccctggggttggtctcaggtcccatatcacaagccagctgtcttcctttcagcccgggccgtgcaacggggaccttcgacaatgagattgtcatgatgaatcacgtgtaccgggagaggttccccaaggccacagcacagatggagggccgtctgcaggagttcctgacggcctacgcgcccggcgcccggctggcgctggctgatggcgtcttgggcttcatccaccaccagatcgtcgagctggcccgagactgcttggccaagtctggcgagaacctcgtcacctcccgctacttcctagagatgcaggagaagctggagcggcttctgcaggatgcccatgagcgttcggacagtgaggaggtcagcttcatcgtccagcttgtccggaaactgctgatcatcatctcacggccagctcggctgctggagtgtctggagtttgaccctgaggaattttaccacctgctggaggcggctgagggccatgcgcgggagggccaaggcattaagactgaccttccacagtacatcattgggcagctgggcctggccaaggaccccctggaggagatggtgccactgagtcacctcgaagaagaacagcccccagcacctgagtccccagagagccgcgccctggtcggccagtcacggaggaagccatgcgaaagcgactttgagaccatcaaactcattagcaacggagcctatggggccgtctacctggtgcggcaccgtgacacacggcagcgctttgccatcaagaagatcaacaaacagaacttgatcctgcgtaaccagatccagcaggtctttgtggagcgtgacattctcacctttgccgagaacccctttgtggtcagcatgttctgctcctttgagacccggcgccacctatgtatggtcatggaatacgtggaaggcggcgactgcgccacgctcctgaagaacatgggcccgctgcccgtggacatggcccgcctgtacttcgccgagacggtgttggcgctggagtacctgcataactatggcatcgtgcaccgtgacctcaaaccagacaatctgctcatcacctcgcttggccacatcaagctcacggacttcggcctgtccaagatcggcctcatgagcatggccaccaacctctatgagggccacatcgagaaggacgcccgagagttcatcgacaagcaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcgatgagatcatgtggccagagggagatgaggcccttccagcagacgcccaggacctcatcaccaggttgctccggcagagcccgctggaccgtctgggcactggtggcacccacgaagtgaagcagcacccctttttcctggccctggactgggcagggcttctccgacacaaagccgagttcgtgccccagctcgaagccgaggatgataccagctactttgacacacgttcggaacgttaccgccatctgggctccgaggacgacgagaccaatgatgaagaatcgtccacagagatcccccagttctcctcctgctcccaccggttcagcaaggtctacagcagctctgagttcctggccgtccagcccactcctaccttcgctgaaaggagcttcagtgaagaccgggaggaggggtgggagcgcagcgaagtggactatggccgccggctgagtgctgacatccggctgaggtcctggacatcctctggatcctcctgtcagtcatcttcgtcccagcccgagcggggtcccagcccatctctcctgaataccatcagcctggacacaatgcccaagtttgccttctcatcagaggatgagggggtaggcccaggccctgcaggccccaagaggcccgtcttcattctaggggagcctgaccccccaccagcggccaccccagtgatgcccaagccctcgagcctttctgccgacacagctgctctcagccacgcccgcctacggagcaatagcatcggcgcccgacactccacaccaaggcctctggatgccagccggggccgccgccttgggggcccaagagacccagcccctgagaagtccagagcctcctccagcggtggcagtggtggcggcagtgggggccgcgtgcccaagtcagcctctgtctctgccctgtccctcatcatcacggcagatgatggcagcggcggccccctcatgagccccctttccccgcgctctctgtcctcgaacccgtcgtcccgtgactcttcgccgagccgagacccgtcccccgtgtgtggcagcctgcggccccccatcgttatccacagctctggcaagaagtacggcttcagcctgcgggcgatccgcgtctacatgggtgatagcgacgtctacactgtgcaccacgtcgtctggagtgtggaggacggaagccccgcccaggaggcgggcctgcgggctggggacctcatcacccacatcaacggggagtcagtgctggggctggtgcacatggacgtcgtggagctgctgctgaagagcggcaacaagatatccctgcggaccacagccctggagaacacctccatcaaggtgggccccgcccggaagaatgtggccaagggccgcatggcacgcaggagcaagaggagccgtcggcgggagacccaggatcggcggaagtcacttttcaagaagatctccaagcagacctccgtgctgcacaccagccgcagcttctcctccggactccaccactcactgtcatccagtgagagcctccccggctcgcccacccacagcctctcccccagccccaccactccctgccgaagcccagcccctgatgtcccagcagataccactgcatccccacccagcgcatccccgagctccagcagccccgcctccccagctgctgctggccacacccgccccagctccctgcacggcctggctgccaagcttgggccaccccgccccaagactggccgccgcaagtccaccagcagcatcccgccctccccgctggcctgcccgcccatctccgcgcccccaccccgctcgccctcgcccctgcccgggcacccgcccgcacctgcccgatccccgcggctgcgccggggccagtcagctgacaagctgggcacaggggagcggctggatggggaggcggggcggcgcactcgtgggccagaggccgagctcgtggtcatgcggcggctgcacctgtccgagcgccgagactccttcaagaagcaggaggccgtgcaggaggttagcttcgatgagccgcaggaggaggccactgggctgcccacctcagtgccacagatcgccgtggagggcgaggaagccgtgccagtagctctcgggcccaccggaagagactgatcccctgccaggtctctccctggcatcaaagttacgcgttttcttgtgcaatgttttttccgtaaagtcatgcctggatggggactgagccaccagcctgacacccagaaggcgagaagccatctcggtccttgctggaaggtggagacatcgcttgtgttctggtgtcaatcaggggctggatggggcaagaatgggggacaagggtggctttgtaaatagcagcaaatccctgcaactaatttattactttttttttcttttttttttttttttttgagacagagtctcactctgttgcccgggctggagtgcagcggcgtgatctcagctcactgcaacctccgcctcccaagttcaagcgattgtcctgcctcagcttcccaagtggctgggattacaggcgcccaccactatgcccagctaattttttgtatttttagtacagacggggtttcaccatgttggtcaggctggtctcgaactcctgacctcatgatttgcctgcctttgcctcccaaagtgctgggattacaggcgtgagccactgggcccagcctaatttattactttttataagcgatagccgtactgagccgccccctgaaggcggctgccaggtcttgccccaggcacctgggactctgtttgcaggccctgccctctgggctgagaaggatgcactttggacaagtcatctgtgtttgtgttttccagtttttctgtactttttaagtgttttgtgttacctggtctcattcccctccccacacctacccatttgaggggatggagttgaagtcacctggtcacctgtaccggcccagttcggctacaacctggagtgtccgtaaacaattcctctcacccacaaaacaatgtaatcccagcgatggactggattctgaaggccacttcccaccatcatagctgccatgcccaggcagtgcctgctctatatatagagtctgcctccaatcctgctggcttcagcctggagaagggatatgggagctggagctttgatggatgaataggtgttcaccggatctgggcagaggggtcatccgctccccaggtgggcactgataaaggaaggtacaggcctcacctggaactgccaaggcagcctccagaaatgctcggctgtctcggggcacgctccagtatgccagtcctgcgggattacgtccagctacttccagaaacactcagtgtcccctcccctcaggctctgccttggcctggccttgtccagtctaccctggacaagatgccgtgtgtttgaggcccagcagagtaagcccttggccgtgatgtgtctgaaacacctgttaggggttccctccatatgtcagagcctctctgggatgaagttcaagccagaaaacccagtcgaggctcaagtttgaatttcagcttcactgtgtggctctgggaaaatggctttcccactctgtgcctcagtttccttgtgtttacaagactaatcccattgactgtttattaagcacctactgtgtgccaagcgcttttacgtggcttctccctcagccagccttgagaaggctggaggtggtgtcatcacctccattttacagacaaagcagctgagaccccagcgaggggcggagacctgtcccacgatcacccagcaggagtcgtggcagaacggagcatcagccagaccctgttgtgggcgttgtcatcaagggagcttgaatggagggtctggtgtcagatacagccgactccagccccagctcatcccccatgatgctgtgtgacccactgggcactctggtgagggagctttccagacatcaacagcccactctgcttccctttctgagtcccctgtccagcactgcctagtgttggagggtagaccaaggctgtgcatgattcaccccctccttccatcctggagctggcagtgaataaaagcccgtatttacaaaga

SEQ ID NO: 419483 - DNA, 5634 bp, Homo sapiens
cagccccggcccctccctgggctggtgtggaggcccaagttgtggctcctccttcaccccagccctgaccctgcctgagcctagcctctgattcttgtccctcaaccctggctcagatcccccaacatcctcccctggggttggtctcaggtcccatatcacaagccagctgtcttcctttcagcccgggccgtgcaacggggaccttcgacaatgagattgtcatgatgaatcacgtgtaccgggagaggttccccaaggccacagcacagatggagggccgtctgcaggagttcctgacggcctacgcgcccggcgcccggctggcgctggctgatggcgtcttgggcttcatccaccaccagatcgtcgagctggcccgagactgcttggccaagtctggcgagaacctcgtcacctcccgctacttcctagagatgcaggagaagctggagcggcttctgcaggatgcccatgagcgttcggacagtgaggaggtcagcttcatcgtccagcttgtccggaaactgctgatcatcatctcacggccagctcggctgctggagtgtctggagtttgaccctgaggaattttaccacctgctggaggcggctgagggccatgcgcgggagggccaaggcattaagactgaccttccacagtacatcattgggcagctgggcctggccaaggaccccctggaggagatggtgccactgagtcacctcgaagaagaacagcccccagcacctgagtccccagagagccgcgccctggtcggccagtcacggaggaagccatgcgaaagcgactttgagaccatcaaactcattagcaacggagcctatggggccgtctacctggtgcggcaccgtgacacacggcagcgctttgccatcaagaagatcaacaaacagaacttgatcctgcgtaaccagatccagcaggtctttgtggagcgtgacattctcacctttgccgagaacccctttgtggtcagcatgttctgctcctttgagacccggcgccacctatgtatggtcatggaatacgtggaaggcggcgactgcgccacgctcctgaagaacatgggcccgctgcccgtggacatggcccgcctgtacttcgccgagacggtgttggcgctggagtacctgcataactatggcatcgtgcaccgtgacctcaaaccagacaatctgctcatcacctcgcttggccacatcaagctcacggacttcggcctgtccaagatcggcctcatgagcatggccaccaacctctatgagggccacatcgagaaggacgcccgagagttcatcgacaagcaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcgatgagatcatgtggccagagggagatgaggcccttccagcagacgcccaggacctcatcaccaggttgctccggcagagcccgctggaccgtctgggcactggtggcacccacgaagtgaagcagcacccctttttcctggccctggactgggcagggcttctccgacacaaagccgagttcgtgccccagctcgaagccgaggatgataccagctactttgacacacgttcggaacgttaccgccatctgggctccgaggacgacgagaccaatgatgaagaatcgtccacagagatcccccagttctcctcctgctcccaccggttcagcaaggtctacagcagctctgagttcctggccgtccagcccactcctaccttcgctgaaaggagcttcagtgaagaccgggaggaggggtgggagcgcagcgaagtggactatggccgccggctgagtgctgacatccggctgaggtcctggacatcctctggatcctcctgtcagtcatcttcgtcccagcccgagcggggtcccagcccatctctcctgaataccatcagcctggacacaatgcccaagtttgccttctcatcagaggatgagggggtaggcccaggccctgcaggccccaagaggcccgtcttcattctaggggagcctgaccccccaccagcggccaccccagtgatgcccaagccctcgagcctttctgccgacacagctgctctcagccacgcccgcctacggagcaatagcatcggcgcccgacactccacaccaaggcctctggatgccagccggggccgccgccttgggggcccaagagacccagcccctgagaagtccagagcctcctccagcggtggcagtggtggcggcagtgggggccgcgtgcccaagtcagcctctgtctctgccctgtccctcatcatcacggcagatgatggcagcggcggccccctcatgagccccctttccccgcgctctctgtcctcgaacccgtcgtcccgtgactcttcgccgagccgagacccgtcccccgtgtgtggcagcctgcggccccccatcgttatccacagctctggcaagaagtacggcttcagcctgcgggcgatccgcgtctacatgggtgatagcgacgtctacactgtgcaccacgtcgtctggagtgtggaggacggaagccccgcccaggaggcgggcctgcgggctggggacctcatcacccacatcaacggggagtcagtgctggggctggtgcacatggacgtcgtggagctgctgctgaagagcggcaacaagatatccctgcggaccacagccctggagaacacctccatcaaggtgggccccgcccggaagaatgtggccaagggccgcatggcacgcaggagcaagaggagccgtcggcgggagacccaggatcggtgcgcggcagtgaccaccagggagcggcggaagtcacttttcaagaagatctccaagcagacctccgtgctgcacaccagccgcagcttctcctccggactccaccactcactgtcatccagtgagagcctccccggctcgcccacccacagcctctcccccagccccaccactccctgccgaagcccagcccctgatgtcccagcagataccactgcatccccacccagcgcatccccgagctccagcagccccgcctccccagctgctgctggccacacccgccccagctccctgcacggcctggctgccaagcttgggccaccccgccccaagactggccgccgcaagtccaccagcagcatcccgccctccccgctggcctgcccgcccatctccgcgcccccaccccgctcgccctcgcccctgcccgggcacccgcccgcacctgcccgatccccgcggctgcgccggggccagtcagctgacaagctgggcacaggggagcggctggatggggaggcggggcggcgcactcgtgggccagaggccgagctcgtggtcatgcggcggctgcacctgtccgagcgccgagactccttcaagaagcaggaggccgtgcaggaggttagcttcgatgagccgcaggaggaggccactgggctgcccacctcagtgccacagatcgccgtggagggcgaggaagccgtgccagtagctctcgggcccaccggaagagactgatcccctgccaggtctctccctggcatcaaagttacgcgttttcttgtgcaatgttttttccgtaaagtcatgcctggatggggactgagccaccagcctgacacccagaaggcgagaagccatctcggtccttgctggaaggtggagacatcgcttgtgttctggtgtcaatcaggggctggatggggcaagaatgggggacaagggtggctttgtaaatagcagcaaatccctgcaactaatttattactttttttttcttttttttttttttttttgagacagagtctcactctgttgcccgggctggagtgcagcggcgtgatctcagctcactgcaacctccgcctcccaagttcaagcgattgtcctgcctcagcttcccaagtggctgggattacaggcgcccaccactatgcccagctaattttttgtatttttagtacagacggggtttcaccatgttggtcaggctggtctcgaactcctgacctcatgatttgcctgcctttgcctcccaaagtgctgggattacaggcgtgagccactgggcccagcctaatttattactttttataagcgatagccgtactgagccgccccctgaaggcggctgccaggtcttgccccaggcacctgggactctgtttgcaggccctgccctctgggctgagaaggatgcactttggacaagtcatctgtgtttgtgttttccagtttttctgtactttttaagtgttttgtgttacctggtctcattcccctccccacacctacccatttgaggggatggagttgaagtcacctggtcacctgtaccggcccagttcggctacaacctggagtgtccgtaaacaattcctctcacccacaaaacaatgtaatcccagcgatggactggattctgaaggccacttcccaccatcatagctgccatgcccaggcagtgcctgctctatatatagagtctgcctccaatcctgctggcttcagcctggagaagggatatgggagctggagctttgatggatgaataggtgttcaccggatctgggcagaggggtcatccgctccccaggtgggcactgataaaggaaggtacaggcctcacctggaactgccaaggcagcctccagaaatgctcggctgtctcggggcacgctccagtatgccagtcctgcgggattacgtccagctacttccagaaacactcagtgtcccctcccctcaggctctgccttggcctggccttgtccagtctaccctggacaagatgccgtgtgtttgaggcccagcagagtaagcccttggccgtgatgtgtctgaaacacctgttaggggttccctccatatgtcagagcctctctgggatgaagttcaagccagaaaacccagtcgaggctcaagtttgaatttcagcttcactgtgtggctctgggaaaatggctttcccactctgtgcctcagtttccttgtgtttacaagactaatcccattgactgtttattaagcacctactgtgtgccaagcgcttttacgtggcttctccctcagccagccttgagaaggctggaggtggtgtcatcacctccattttacagacaaagcagctgagaccccagcgaggggcggagacctgtcccacgatcacccagcaggagtcgtggcagaacggagcatcagccagaccctgttgtgggcgttgtcatcaagggagcttgaatggagggtctggtgtcagatacagccgactccagccccagctcatcccccatgatgctgtgtgacccactgggcactctggtgagggagctttccagacatcaacagcccactctgcttccctttctgagtcccctgtccagcactgcctagtgttggagggtagaccaaggctgtgcatgattcaccccctccttccatcctggagctggcagtgaataaaagcccgtatttacaaaga

SEQ ID NO: 419484 - DNA, 5495 bp, Homo sapiens
cagccccggcccctccctgggctggtgtggaggcccaagttgtggctcctccttcaccccagccctgaccctgcctgagcctagcctctgattcttgtccctcaaccctggctcagatcccccaacatcctcccctggggttggtctcaggtcccatatcacaagccagctgtcttcctttcagcccgggccgtgcaacggggaccttcgacaatgagattgtcatgatgaatcacgtgtaccgggagaggttccccaaggccacagcacagatggagggccgtctgcaggagttcctgacggcctacgcgcccggcgcccggctggcgctggctgatggcgtcttgggcttcatccaccaccagatcgtcgagctggcccgagactgcttggccaagtctggcgagaacctcgtcacctcccgctacttcctagagatgcaggagaagctggagcggcttctgcaggatgcccatgagcgttcggacagtgaggaggtcagcttcatcgtccagcttgtccggaaactgctgatcatcatctcacggccagctcggctgctggagtgtctggagtttgaccctgaggaattttaccacctgctggaggcggctgagggccatgcgcgggagggccaaggcattaagactgaccttccacagtacatcattgggcagctgggcctggccaaggaccccctggaggagatggtgccactgagtcacctcgaagaagaacagcccccagcacctgagtccccagagagccgcgccctggtcggccagtcacggaggaagccatgcgaaagcgactttgagaccatcaaactcattagcaacggagcctatggggccgtctacctggtgcggcaccgtgacacacggcagcgctttgccatcaagaagatcaacaaacagaacttgatcctgcgtaaccagatccagcaggtctttgtggagcgtgacattctcacctttgccgagaacccctttgtggtcagcatgttctgctcctttgagacccggcgccacctatgtatggtcatggaatacgtggaaggcggcgactgcgccacgctcctgaagaacatgggcccgctgcccgtggacatggcccgcctgtacttcgccgagacggtgttggcgctggagtacctgcataactatggcatcgtgcaccgtgacctcaaaccagacaatctgctcatcacctcgcttggccacatcaagctcacggacttcggcctgtccaagatcggcctcatgagcatggccaccaacctctatgagggccacatcgagaaggacgcccgagagttcatcgacaagcaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcgatgagatcatgtggccagagggagatgaggcccttccagcagacgcccaggacctcatcaccaggttgctccggcagagcccgctggaccgtctgggcactggtggcacccacgaagtgaagcagcacccctttttcctggccctggactgggcagggcttctccgacacaaagccgagttcgtgccccagctcgaagccgaggatgataccagctactttgacacacgttcggaacgttaccgccatctgggctccgaggacgacgagaccaatgatgaagaatcgtccacagagatcccccagttctcctcctgctcccaccggttcagcaaggtctacagcagctctgagttcctggccgtccagcccactcctaccttcgctgaaaggagcttcagtgaagaccgggaggaggggtgggagcgcagcgaagtggactatggccgccggctgagtgctgacatccggctgaggtcctggacatcctctggatcctcctgtcagtcatcttcgtcccagcccgagcggggtcccagcccatctctcctgaataccatcagcctggacacaatgcccaagtttgccttctcatcagaggatgagggggtaggcccaggccctgcaggccccaagaggcccgtcttcattctaggggagcctgaccccccaccagcggccaccccagtgatgcccaagccctcgagcctttctgccgacacagctgctctcagccacgcccgcctacggagcaatagcatcggcgcccgacactccacaccaaggcctctggatgccagccggggccgccgccttgggggcccaagagacccagcccctgagaagtccagagcctcctccagcggtggcagtggtggcggcagtgggggccgcgtgcccaagtcagcctctgtctctgccctgtccctcatcatcacggcagctctggcaagaagtacggcttcagcctgcgggcgatccgcgtctacatgggtgatagcgacgtctacactgtgcaccacgtcgtctggagtgtggaggacggaagccccgcccaggaggcgggcctgcgggctggggacctcatcacccacatcaacggggagtcagtgctggggctggtgcacatggacgtcgtggagctgctgctgaagagcggcaacaagatatccctgcggaccacagccctggagaacacctccatcaaggtgggccccgcccggaagaatgtggccaagggccgcatggcacgcaggagcaagaggagccgtcggcgggagacccaggatcggtgcgcggcagtgaccaccagggagcggcggaagtcacttttcaagaagatctccaagcagacctccgtgctgcacaccagccgcagcttctcctccggactccaccactcactgtcatccagtgagagcctccccggctcgcccacccacagcctctcccccagccccaccactccctgccgaagcccagcccctgatgtcccagcagataccactgcatccccacccagcgcatccccgagctccagcagccccgcctccccagctgctgctggccacacccgccccagctccctgcacggcctggctgccaagcttgggccaccccgccccaagactggccgccgcaagtccaccagcagcatcccgccctccccgctggcctgcccgcccatctccgcgcccccaccccgctcgccctcgcccctgcccgggcacccgcccgcacctgcccgatccccgcggctgcgccggggccagtcagctgacaagctgggcacaggggagcggctggatggggaggcggggcggcgcactcgtgggccagaggccgagctcgtggtcatgcggcggctgcacctgtccgagcgccgagactccttcaagaagcaggaggccgtgcaggaggttagcttcgatgagccgcaggaggaggccactgggctgcccacctcagtgccacagatcgccgtggagggcgaggaagccgtgccagtagctctcgggcccaccggaagagactgatcccctgccaggtctctccctggcatcaaagttacgcgttttcttgtgcaatgttttttccgtaaagtcatgcctggatggggactgagccaccagcctgacacccagaaggcgagaagccatctcggtccttgctggaaggtggagacatcgcttgtgttctggtgtcaatcaggggctggatggggcaagaatgggggacaagggtggctttgtaaatagcagcaaatccctgcaactaatttattactttttttttcttttttttttttttttttgagacagagtctcactctgttgcccgggctggagtgcagcggcgtgatctcagctcactgcaacctccgcctcccaagttcaagcgattgtcctgcctcagcttcccaagtggctgggattacaggcgcccaccactatgcccagctaattttttgtatttttagtacagacggggtttcaccatgttggtcaggctggtctcgaactcctgacctcatgatttgcctgcctttgcctcccaaagtgctgggattacaggcgtgagccactgggcccagcctaatttattactttttataagcgatagccgtactgagccgccccctgaaggcggctgccaggtcttgccccaggcacctgggactctgtttgcaggccctgccctctgggctgagaaggatgcactttggacaagtcatctgtgtttgtgttttccagtttttctgtactttttaagtgttttgtgttacctggtctcattcccctccccacacctacccatttgaggggatggagttgaagtcacctggtcacctgtaccggcccagttcggctacaacctggagtgtccgtaaacaattcctctcacccacaaaacaatgtaatcccagcgatggactggattctgaaggccacttcccaccatcatagctgccatgcccaggcagtgcctgctctatatatagagtctgcctccaatcctgctggcttcagcctggagaagggatatgggagctggagctttgatggatgaataggtgttcaccggatctgggcagaggggtcatccgctccccaggtgggcactgataaaggaaggtacaggcctcacctggaactgccaaggcagcctccagaaatgctcggctgtctcggggcacgctccagtatgccagtcctgcgggattacgtccagctacttccagaaacactcagtgtcccctcccctcaggctctgccttggcctggccttgtccagtctaccctggacaagatgccgtgtgtttgaggcccagcagagtaagcccttggccgtgatgtgtctgaaacacctgttaggggttccctccatatgtcagagcctctctgggatgaagttcaagccagaaaacccagtcgaggctcaagtttgaatttcagcttcactgtgtggctctgggaaaatggctttcccactctgtgcctcagtttccttgtgtttacaagactaatcccattgactgtttattaagcacctactgtgtgccaagcgcttttacgtggcttctccctcagccagccttgagaaggctggaggtggtgtcatcacctccattttacagacaaagcagctgagaccccagcgaggggcggagacctgtcccacgatcacccagcaggagtcgtggcagaacggagcatcagccagaccctgttgtgggcgttgtcatcaagggagcttgaatggagggtctggtgtcagatacagccgactccagccccagctcatcccccatgatgctgtgtgacccactgggcactctggtgagggagctttccagacatcaacagcccactctgcttccctttctgagtcccctgtccagcactgcctagtgttggagggtagaccaaggctgtgcatgattcaccccctccttccatcctggagctggcagtgaataaaagcccgtatttacaaaga

SEQ ID NO: 419485 - DNA, 5422 bp, Homo sapiens
cagccccggcccctccctgggctggtgtggaggcccaagttgtggctcctccttcaccccagccctgaccctgcctgagcctagcctctgattcttgtccctcaaccctggctcagatcccccaacatcctcccctggggttggtctcaggtcccatatcacaagccagctgtcttcctttcagcccgggccgtgcaacggggaccttcgacaatgagattgtcatgatgaatcacgtgtaccgggagaggttccccaaggccacagcacagatggagggccgtctgcaggagttcctgacggcctacgcgcccggcgcccggctggcgctggctgatggcgtcttgggcttcatccaccaccagatcgtcgagctggcccgagactgcttggccaagtctggcgagaacctcgtcacctcccgctacttcctagagatgcaggagaagctggagcggcttctgcaggatgcccatgagcgttcggacagtgaggaggtcagcttcatcgtccagcttgtccggaaactgctgatcatcatctcacggccagctcggctgctggagtgtctggagtttgaccctgaggaattttaccacctgctggaggcggctgagggccatgcgcgggagggccaaggcattaagactgaccttccacagtacatcattgggcagctgggcctggccaaggaccccctggaggagatggtgccactgagtcacctcgaagaagaacagcccccagcacctgagtccccagagagccgcgccctggtcggccagtcacggaggaagccatgcgaaagcgactttgagaccatcaaactcattagcaacggagcctatggggccgtctacctggtgcggcaccgtgacacacggcagcgctttgccatcaagaagatcaacaaacagaacttgatcctgcgtaaccagatccagcaggtctttgtggagcgtgacattctcacctttgccgagaacccctttgtggtcagcatgttctgctcctttgagacccggcgccacctatgtatggtcatggaatacgtggaaggcggcgactgcgccacgctcctgaagaacatgggcccgctgcccgtggacatggcccgcctgtacttcgccgagacggtgttggcgctggagtacctgcataactatggcatcgtgcaccgtgacctcaaaccagacaatctgctcatcacctcgcttggccacatcaagctcacggacttcggcctgtccaagatcggcctcatgagcatggccaccaacctctatgagggccacatcgagaaggacgcccgagagttcatcgacaagcaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcgatgagatcatgtggccagagggagatgaggcccttccagcagacgcccaggacctcatcaccaggttgctccggcagagcccgctggaccgtctgggcactggtggcacccacgaagtgaagcagcacccctttttcctggccctggactgggcagggcttctccgacacaaagccgagttcgtgccccagctcgaagccgaggatgataccagctactttgacacacgttcggaacgttaccgccatctgggctccgaggacgacgagaccaatgatgaagaatcgtccacagagatcccccagttctcctcctgctcccaccggttcagcaaggtctacagcagctctgagttcctggccgtccagcccactcctaccttcgctgaaaggagcttcagtgaagaccgggaggaggggtgggagcgcagcgaagtggactatggccgccggctgagtgctgacatccggggagcctgaccccccaccagcggccaccccagtgatgcccaagccctcgagcctttctgccgacacagctgctctcagccacgcccgcctacggagcaatagcatcggcgcccgacactccacaccaaggcctctggatgccagccggggccgccgccttgggggcccaagagacccagcccctgagaagtccagagcctcctccagcggtggcagtggtggcggcagtgggggccgcgtgcccaagtcagcctctgtctctgccctgtccctcatcatcacggcagatgatggcagcggcggccccctcatgagccccctttccccgcgctctctgtcctcgaacccgtcgtcccgtgactcttcgccgagccgagacccgtcccccgtgtgtggcagcctgcggccccccatcgttatccacagctctggcaagaagtacggcttcagcctgcgggcgatccgcgtctacatgggtgatagcgacgtctacactgtgcaccacgtcgtctggagtgtggaggacggaagccccgcccaggaggcgggcctgcgggctggggacctcatcacccacatcaacggggagtcagtgctggggctggtgcacatggacgtcgtggagctgctgctgaagagcggcaacaagatatccctgcggaccacagccctggagaacacctccatcaaggtgggccccgcccggaagaatgtggccaagggccgcatggcacgcaggagcaagaggagccgtcggcgggagacccaggatcggcggaagtcacttttcaagaagatctccaagcagacctccgtgctgcacaccagccgcagcttctcctccggactccaccactcactgtcatccagtgagagcctccccggctcgcccacccacagcctctcccccagccccaccactccctgccgaagcccagcccctgatgtcccagcagataccactgcatccccacccagcgcatccccgagctccagcagccccgcctccccagctgctgctggccacacccgccccagctccctgcacggcctggctgccaagcttgggccaccccgccccaagactggccgccgcaagtccaccagcagcatcccgccctccccgctggcctgcccgcccatctccgcgcccccaccccgctcgccctcgcccctgcccgggcacccgcccgcacctgcccgatccccgcggctgcgccggggccagtcagctgacaagctgggcacaggggagcggctggatggggaggcggggcggcgcactcgtgggccagaggccgagctcgtggtcatgcggcggctgcacctgtccgagcgccgagactccttcaagaagcaggaggccgtgcaggaggttagcttcgatgagccgcaggaggaggccactgggctgcccacctcagtgccacagatcgccgtggagggcgaggaagccgtgccagtagctctcgggcccaccggaagagactgatcccctgccaggtctctccctggcatcaaagttacgcgttttcttgtgcaatgttttttccgtaaagtcatgcctggatggggactgagccaccagcctgacacccagaaggcgagaagccatctcggtccttgctggaaggtggagacatcgcttgtgttctggtgtcaatcaggggctggatggggcaagaatgggggacaagggtggctttgtaaatagcagcaaatccctgcaactaatttattactttttttttcttttttttttttttttttgagacagagtctcactctgttgcccgggctggagtgcagcggcgtgatctcagctcactgcaacctccgcctcccaagttcaagcgattgtcctgcctcagcttcccaagtggctgggattacaggcgcccaccactatgcccagctaattttttgtatttttagtacagacggggtttcaccatgttggtcaggctggtctcgaactcctgacctcatgatttgcctgcctttgcctcccaaagtgctgggattacaggcgtgagccactgggcccagcctaatttattactttttataagcgatagccgtactgagccgccccctgaaggcggctgccaggtcttgccccaggcacctgggactctgtttgcaggccctgccctctgggctgagaaggatgcactttggacaagtcatctgtgtttgtgttttccagtttttctgtactttttaagtgttttgtgttacctggtctcattcccctccccacacctacccatttgaggggatggagttgaagtcacctggtcacctgtaccggcccagttcggctacaacctggagtgtccgtaaacaattcctctcacccacaaaacaatgtaatcccagcgatggactggattctgaaggccacttcccaccatcatagctgccatgcccaggcagtgcctgctctatatatagagtctgcctccaatcctgctggcttcagcctggagaagggatatgggagctggagctttgatggatgaataggtgttcaccggatctgggcagaggggtcatccgctccccaggtgggcactgataaaggaaggtacaggcctcacctggaactgccaaggcagcctccagaaatgctcggctgtctcggggcacgctccagtatgccagtcctgcgggattacgtccagctacttccagaaacactcagtgtcccctcccctcaggctctgccttggcctggccttgtccagtctaccctggacaagatgccgtgtgtttgaggcccagcagagtaagcccttggccgtgatgtgtctgaaacacctgttaggggttccctccatatgtcagagcctctctgggatgaagttcaagccagaaaacccagtcgaggctcaagtttgaatttcagcttcactgtgtggctctgggaaaatggctttcccactctgtgcctcagtttccttgtgtttacaagactaatcccattgactgtttattaagcacctactgtgtgccaagcgcttttacgtggcttctccctcagccagccttgagaaggctggaggtggtgtcatcacctccattttacagacaaagcagctgagaccccagcgaggggcggagacctgtcccacgatcacccagcaggagtcgtggcagaacggagcatcagccagaccctgttgtgggcgttgtcatcaagggagcttgaatggagggtctggtgtcagatacagccgactccagccccagctcatcccccatgatgctgtgtgacccactgggcactctggtgagggagctttccagacatcaacagcccactctgcttccctttctgagtcccctgtccagcactgcctagtgttggagggtagaccaaggctgtgcatgattcaccccctccttccatcctggagctggcagtgaataaaagcccgtatttacaaaga

SEQ ID NO: 419486 - DNA, 3739 bp, Homo sapiens
cacgagggttcgctgccctgaagttcagttagtgcctctgagagcaccttaatgttgctctgcctcactcagctggccaaggggttggtgacacccgagctgaggtcctggacatcctctggatcctcctgtcagtcatcttcgtcccagcccgagcggggtcccagcccatctctcctgaataccatcagcctggacacaatgcccaagtttgccttctcatcagaggatgagggggtaggcccaggccctgcaggccccaagaggcccgtcttcattctaggggagcctgaccccccaccagcggccaccccagtgatgcccaagccctcgagcctttctgccgacacagctgctctcagccacgcccgcctacggagcaatagcatcggcgcccgacactccacaccaaggcctctggatgccagccggggccgccgccttgggggcccaagagacccagcccctgagaagtccagagcctcctccagcggtggcagtggtggcggcagtgggggccgcgtgcccaagtcagcctctgtctctgccctgtccctcatcatcacggcagatgatggcagcggcggccccctcatgagccccctttccccgcgctctctgtcctcgaacccgtcgtcccgtgactcttcgccgagccgagacccgtcccccgtgtgtggcagcctgcggccccccatcgttatccacagctctggcaagaagtacggcttcagcctgcgggcgatccgcgtctacatgggtgatagcgacgtctacactgtgcaccacgtcgtctggagtgtggaggacggaagccccgcccaggaggcgggcctgcgggctggggacctcatcacccacatcaacggggagtcagtgctggggctggtgcacatggacgtcgtggagctgctgctgaagagcggcaacaagatatccctgcggaccacagccctggagaacacctccatcaaggtgggccccgcccggaagaatgtggccaagggccgcatggcacgcaggagcaagaggagccgtcggcgggagacccaggatcggcggaagtcacttttcaagaagatctccaagcagacctccgtgctgcacaccagccgcagcttctcctccggactccaccactcactgtcatccagtgagagcctccccggctcgcccacccacagcctctcccccagccccaccactccctgccgaagcccagcccctgatgtcccagcagataccactgcatccccacccagcgcatccccgagctccagcagccccgcctccccagctgctgctggccacacccgccccagctccctgcacggcctggctgccaagcttgggccaccccgccccaagactggccgccgcaagtccaccagcagcatcccgccctccccgctggcctgcccgcccatctccgcgcccccaccccgctcgccctcgcccctgcccgggcacccgcccgcacctgcccgatccccgcggctgcgccggggccagtcagctgacaagctgggcacaggggagcggctggatggggaggcggggcggcgcactcgtgggccagaggccgagctcgtggtcatgcggcggctgcacctgtccgagcgccgagactccttcaagaagcaggaggccgtgcaggaggttagcttcgatgagccgcaggaggaggccactgggctgcccacctcagtgccacagatcgccgtggagggcgaggaagccgtgccagtagctctcgggcccaccggaagagactgatcccctgccaggtctctccctggcatcaaagttacgcgttttcttgtgcaatgttttttccgtaaagtcatgcctggatggggactgagccaccagcctgacacccagaaggcgagaagccatctcggtccttgctggaaggtggagacatcgcttgtgttctggtgtcaatcaggggctggatggggcaagaatgggggacaagggtggctttgtaaatagcagcaaatccctgcaactaatttattactttttttttcttttttttttttttttttgagacagagtctcactctgttgcccgggctggagtgcagcggcgtgatctcagctcactgcaacctccgcctcccaagttcaagcgattgtcctgcctcagcttcccaagtggctgggattacaggcgcccaccactatgcccagctaattttttgtatttttagtacagacggggtttcaccatgttggtcaggctggtctcgaactcctgacctcatgatttgcctgcctttgcctcccaaagtgctgggattacaggcgtgagccactgggcccagcctaatttattactttttataagcgatagccgtactgagccgccccctgaaggcggctgccaggtcttgccccaggcacctgggactctgtttgcaggccctgccctctgggctgagaaggatgcactttggacaagtcatctgtgtttgtgttttccagtttttctgtactttttaagtgttttgtgttacctggtctcattcccctccccacacctacccatttgaggggatggagttgaagtcacctggtcacctgtaccggcccagttcggctacaacctggagtgtccgtaaacaattcctctcacccacaaaacaatgtaatcccagcgatggactggattctgaaggccacttcccaccatcatagctgccatgcccaggcagtgcctgctctatatatagagtctgcctccaatcctgctggcttcagcctggagaagggatatgggagctggagctttgatggatgaataggtgttcaccggatctgggcagaggggtcatccgctccccaggtgggcactgataaaggaaggtacaggcctcacctggaactgccaaggcagcctccagaaatgctcggctgtctcggggcacgctccagtatgccagtcctgcgggattacgtccagctacttccagaaacactcagtgtcccctcccctcaggctctgccttggcctggccttgtccagtctaccctggacaagatgccgtgtgtttgaggcccagcagagtaagcccttggccgtgatgtgtctgaaacacctgttaggggttccctccatatgtcagagcctctctgggatgaagttcaagccagaaaacccagtcgaggctcaagtttgaatttcagcttcactgtgtggctctgggaaaatggctttcccactctgtgcctcagtttccttgtgtttacaagactaatcccattgactgtttattaagcacctactgtgtgccaagcgcttttacgtggcttctccctcagccagccttgagaaggctggaggtggtgtcatcacctccattttacagacaaagcagctgagaccccagcgaggggcggagacctgtcccacgatcacccagcaggagtcgtggcagaacggagcatcagccagaccctgttgtgggcgttgtcatcaagggagcttgaatggagggtctggtgtcagatacagccgactccagccccagctcatcccccatgatgctgtgtgacccactgggcactctggtgagggagctttccagacatcaacagcccactctgcttccctttctgagtcccctgtccagcactgcctagtgttggagggtagaccaaggctgtgcatgattcaccccctccttccatcctggagctggcagtgaataaaagcccgtatttacaaaga

SEQ ID NO: 419487 - DNA, 5553 bp, Homo sapiens
cagccccggcccctccctgggctggtgtggaggcccaagttgtggctcctccttcaccccagccctgaccctgcctgagcctagcctctgattcttgtccctcaaccctggctcagatcccccaacatcctcccctggggttggtctcaggtcccatatcacaagccagctgtcttcctttcagcccgggccgtgcaacggggaccttcgacaatgagattgtcatgatgaatcacgtgtaccgggagaggttccccaaggccacagcacagatggagggccgtctgcaggagttcctgacggcctacgcgcccggcgcccggctggcgctggctgatggcgtcttgggcttcatccaccaccagatcgtcgagctggcccgagactgcttggccaagtctggcgagaacctcgtcacctcccgctacttcctagagatgcaggagaagctggagcggcttctgcaggatgcccatgagcgttcggacagtgaggaggtcagcttcatcgtccagcttgtccggaaactgctgatcatcatctcacggccagctcggctgctggagtgtctggagtttgaccctgaggaattttaccacctgctggaggcggctgagggccatgcgcgggagggccaaggcattaagactgaccttccacagtacatcattgggcagctgggcctggccaaggaccccctggaggagatggtgccactgagtcacctcgaagaagaacagcccccagcacctgagtccccagagagccgcgccctggtcggccagtcacggaggaagccatgcgaaagcgactttgagaccatcaaactcattagcaacggagcctatggggccgtctacctggtgcggcaccgtgacacacggcagcgctttgccatcaagaagatcaacaaacagaacttgatcctgcgtaaccagatccagcaggtctttgtggagcgtgacattctcacctttgccgagaacccctttgtggtcagcatgttctgctcctttgagacccggcgccacctatgtatggtcatggaatacgtggaaggcggcgactgcgccacgctcctgaagaacatgggcccgctgcccgtggacatggcccgcctgtacttcgccgagacggtgttggcgctggagtacctgcataactatggcatcgtgcaccgtgacctcaaaccagacaatctgctcatcacctcgcttggccacatcaagctcacggacttcggcctgtccaagatcggcctcatgagcatggccaccaacctctatgagggccacatcgagaaggacgcccgagagttcatcgacaagcaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcgatgagatcatgtggccagagggagatgaggcccttccagcagacgcccaggacctcatcaccaggttgctccggcagagcccgctggaccgtctgggcactggtggcacccacgaagtgaagcagcacccctttttcctggccctggactgggcagggcttctccgacacaaagccgagttcgtgccccagctcgaagccgaggatgataccagctactttgacacacgttcggaacgttaccgccatctgggctccgaggacgacgagaccaatgatgaagaatcgtccacagagatcccccagttctcctcctgctcccaccggttcagcaaggtctacagcagctctgagttcctggccgtccagcccactcctaccttcgctgaaaggagcttcagtgaagaccgggaggaggggtgggagcgcagcgaagtggactatggccgccggctgagtgctgacatccggctgaggtcctggacatcctctggatcctcctgtcagtcatcttcgtcccagcccgagcggggtcccagcccatctctcctgaataccatcagcctggacacaatgcccaagtttgccttctcatcagaggatgagggggtaggcccaggccctgcaggccccaagaggcccgtcttcattctaggggagcctgaccccccaccagcggccaccccagtgatgcccaagccctcgagcctttctgccgacacagctgctctcagccacgcccgcctacggagcaatagcatcggcgcccgacactccacaccaaggcctctggatgccagccggggccgccgccttgggggcccaagagacccagcccctgagaagtccagagcctcctccagcggtggcagtggtggcggcagtgggggccgcgtgcccaagtcagcctctgtctctgccctgtccctcatcatcacggcagatgatggcagcggcggccccctcatgagccccctttccccgcgctctctgtcctcgaacccgtcgtcccgtgactcttcgccgagccgagacccgtcccccgtgtgtggcagcctgcggccccccatcgttatccacagctctggcaagaagtacggcttcagcctgcgggcgatccgcgtctacatgggtgatagcgacgtctacactgtgcaccacgtcgtctggagtgtggaggacggaagccccgcccaggaggcgggcctgcgggctggggacctcatcacccacatcaacggggagtcagtgctggggctggtgcacatggacgtcgtggagctgctgctgaagagcggcaacaagatatccctgcggaccacagccctggagaacacctccatcaaggtgggccccgcccggaagaatgtggccaagggccgcatggcacgcaggagcaagaggagccgtcggcgggagacccaggatcggcggaagtcacttttcaagaagatctccaagcagacctccgtgctgcacaccagccgcagcttctcctccggactccaccactcactgtcatccagtgagagcctccccggctcgcccacccacagcctctcccccagccccaccactccctgccgaagcccagcccctgatgtcccagcagataccactgcatccccacccagcgcatccccgagctccagcagccccgcctccccagctgctgctggccacacccgccccagctccctgcacggcctggctgccaagcttgggccaccccgccccaagactggccgccgcaagtccaccagcagcatcccgccctccccgctggcctgcccgcccatctccgcgcccccaccccgctcgccctcgcccctgcccgggcacccgcccgcacctgcccgatccccgcggctgcgccggggccagtcagctgacaagctgggcacaggggagcggctggatggggaggcggggcggcgcactcgtgggccagaggccgagctcgtggtcatgcggcggctgcacctgtccgagcgccgagactccttcaagaagcaggaggccgtgcaggaggttagcttcgatgagccgcaggaggaggccactgggctgcccacctcagtgccacagatcgccgtggagggcgaggaagccgtgccagtagctctcgggcccaccggaagagactgatcccctgccaggtctctccctggcatcaaagttacgcgttttcttgtgcaatgttttttccgtaaagtcatgcctggatggggactgagccaccagcctgacacccagaaggcgagaagccatctcggtccttgctggaaggtggagacatcgcttgtgttctggtgtcaatcaggggctggatggggcaagaatgggggacaagggtggctttgtaaatagcagcaaatccctgcaactaatttattactttttttttcttttttttttttttttttgagacagagtctcactctgttgcccgggctggagtgcagcggcgtgatctcagctcactgcaacctccgcctcccaagttcaagcgattgtcctgcctcagcttcccaagtggctgggattacaggcgcccaccactatgcccagctaattttttgtatttttagtacagacggggtttcaccatgttggtcaggctggtctcgaactcctgacctcatgatttgcctgcctttgcctcccaaagtgctgggattacaggcgtgagccactgggcccagcctaatttattactttttataagcgatagccgtactgagccgccccctgaaggcggctgccaggtcttgccccaggcacctgggactctgtttgcaggccctgccctctgggctgagaaggatgcactttggacaagtcatctgtgtttgtgttttccagtttttctgtactttttaagtgttttgtgttacctggtctcattcccctccccacacctacccatttgaggggatggagttgaagtcacctggtcacctgtaccggcccagttcggctacaacctggagtgtccgtaaacaattcctctcacccacaaaacaatgtaatcccagcgatggactggattctgaaggccacttcccaccatcatagctgccatgcccaggcagtgcctgctctatatatagagtctgcctccaatcctgctggcttcagcctggagaagggatatgggagctggagctttgatggatgaataggtgttcaccggatctgggcagaggggtcatccgctccccaggtgggcactgataaaggaaggtacaggcctcacctggaactgccaaggcagcctccagaaatgctcggctgtctcggggcacgctccagtatgccagtcctgcgggattacgtccagctacttccagaaacactcagtgtcccctcccctcaggctctgccttggcctggccttgtccagtctaccctggacaagatgccgtgtgtttgaggcccagcagagtaagcccttggccgtgatgtgtctgaaacacctgttaggggttccctccatatgtcagagcctctctgggatgaagttcaagccagaaaacccagtcgaggctcaagtttgaatttcagcttcactgtgtggctctgggcattgactgtttattaagcacctactgtgtgccaagcgcttttacgtggcttctccctcagccagccttgagaaggctggaggtggtgtcatcacctccattttacagacaaagcagctgagaccccagcgaggggcggagacctgtcccacgatcacccagcaggagtcgtggcagaacggagcatcagccagaccctgttgtgggcgttgtcatcaagggagcttgaatggagggtctggtgtcagatacagccgactccagccccagctcatcccccatgatgctgtgtgacccactgggcactctggtgagggagctttccagacatcaacagcccactctgcttccctttctgagtcccctgtccagcactgcctagtgttggagggtagaccaaggctgtgcatgattcaccccctccttccatcctggagctggcagtgaataaaagcccgtatttacaaaga

SEQ ID NO: 419488 - DNA, 1572 bp, Homo sapiens
  misc_feature (18)..(19): n is a, c, g, or t
ggcacgaggtggcacgannctggaagaattcgcggcttttttgtatttttagtacagacggggtttcaccatgttggtcaggctggtctcgaactcctgacctcatgatttgcctgcctttgcctcccaaagtgctgggattacaggcgtgagccactgggcccagcctaatttattactttttataagcgatagccgtactgagccgccccctgaaggcggctgccaggtcttgccccaggcacctgggactctgtttgcaggccctgccctctgggctgagaaggatgcactttggacaagtcatctgtgtttgtgttttccagtttttctgtactttttaagtgttttgtgttacctggtctcattcccctccccacacctacccatttgaggggatggagttgaagtcacctggtcacctgtaccggcccagttcggctacaacctggagtgtccgtaaacaattcctctcacccacaaaacaatgtaatcccagcgatggactggattctgaaggccacttcccaccatcatagctgccatgcccaggcagtgcctgctctatatatagagtctgcctccaatcctgctggcttcagcctggagaagggatatgggagctggagctttgatggatgaataggtgttcaccggatctgggcagaggggtcatccgctccccaggtgggcactgataaaggaaggtacaggcctcacctggaactgccaaggcagcctccagaaatgctcggctgtctcggggcacgctccagtatgccagtcctgcgggattacgtccagctacttccagaaacactcagtgtcccctcccctcaggctctgccttggcctggccttgtccagtctaccctggacaagatgccgtgtgtttgaggcccagcagagtaagcccttggccgtgatgtgtctgaaacacctgttaggggttccctccatatgtcagagcctctctgggatgaagttcaagccagaaaacccagtcgaggctcaagtttgaatttcagcttcactgtgtggctctgggaaaatggctttcccactctgtgcctcagtttccttgtgtttacaagactaatcccattgactgtttattaagcacctactgtgtgccaagcgcttttacgtggcttctccctcagccagccttgagaaggctggaggtggtgtcatcacctccattttacagacaaagcagctgagaccccagcgaggggcggagacctgtcccacgatcacccagcaggagtcgtggcagaacggagcatcagccagaccctgttgtgggcgttgtcatcaagggagcttgaatggagggtctggtgtcagatacagccgactccagccccagctcatcccccatgatgctgtgtgacccactgggcactctggtgagggagctttccagacatcaacagcccactctgcttccctttctgagtcccctgtccagcactgcctagtgttggagggtagaccaaggctgtgcatgattcaccccctccttccatcctggagctggcagtgaataaaagcccgtatttacaaaga

SEQ ID NO: 419489 - DNA, 5665 bp, Homo sapiens
cagccccggcccctccctgggctggtgtggaggcccaagttgtggctcctccttcaccccagccctgaccctgcctgagcctagcctctgattcttgtccctcaaccctggctcagatcccccaacatcctcccctggggttggtctcaggtcccatatcacaagccagctgtcttcctttcagcccgggccgtgcaacggggaccttcgacaatgagattgtcatgatgaatcacgtgtaccgggagaggttccccaaggccacagcacagatggagggccgtctgcaggagttcctgacggcctacgcgcccggcgcccggctggcgctggctgatggcgtcttgggcttcatccaccaccagatcgtcgagctggcccgagactgcttggccaagtctggcgagaacctcgtcacctcccgctacttcctagagatgcaggagaagctggagcggcttctgcaggatgcccatgagcgttcggacagtgaggaggtcagcttcatcgtccagcttgtccggaaactgctgatcatcatctcacggccagctcggctgctggagtgtctggagtttgaccctgaggaattttaccacctgctggaggcggctgagggccatgcgcgggagggccaaggcattaagactgaccttccacagtacatcattgggcagctgggcctggccaaggaccccctggaggagatggtgccactgagtcacctcgaagaagaacagcccccagcacctgagtccccagagagccgcgccctggtcggccagtcacggaggaagccatgcgaaagcgactttgagaccatcaaactcattagcaacggagcctatggggccgtctacctggtgcggcaccgtgacacacggcagcgctttgccatcaagaagatcaacaaacagaacttgatcctgcgtaaccagatccagcaggtctttgtggagcgtgacattctcacctttgccgagaacccctttgtggtcagcatgttctgctcctttgagacccggcgccacctatgtatggtcatggaatacgtggaaggcggcgactgcgccacgctcctgaagaacatgggcccgctgcccgtggacatggcccgcctgtacttcgccgagacggtgttggcgctggagtacctgcataactatggcatcgtgcaccgtgacctcaaaccagacaatctgctcatcacctcgcttggccacatcaagctcacggacttcggcctgtccaagatcggcctcatgagcatggccaccaacctctatgagggccacatcgagaaggacgcccgagagttcatcgacaagcaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcgatgagatcatgtggccagagggagatgaggcccttccagcagacgcccaggacctcatcaccaggttgctccggcagagcccgctggaccgtctgggcactggtggcacccacgaagtgaagcagcacccctttttcctggccctggactgggcagggcttctccgacacaaagccgagttcgtgccccagctcgaagccgaggatgataccagctactttgacacacgttcggaacgttaccgccatctgggctccgaggacgacgagaccaatgatgaagaatcgtccacagagatcccccagttctcctcctgctcccaccggttcagcaaggtctacagcagctctgagttcctggccgtccagcccactcctaccttcgctgaaaggagcttcagtgaagaccgggaggaggggtgggagcgcagcgaagtggactatggccgccggctgagtgctgacatccggctgaggtcctggacatcctctggatcctcctgtcagtcatcttcgtcccagcccgagcggggtcccagcccatctctcctgaataccatcagcctggacacaatgcccaagtttgccttctcatcagaggatgagggggtaggcccaggccctgcaggccccaagaggcccgtcttcattctaggggagcctgaccccccaccagcggccaccccagtgatgcccaagccctcgagcctttctgccgacacagctgctctcagccacgcccgcctacggagcaatagcatcggcgcccgacactccacaccaaggcctctggatgccagccggggccgccgccttgggggcccaagagacccagcccctgagaagtccagagcctcctccagcggtggcagtggtggcggcagtgggggccgcgtgcccaagtcagcctctgtctctgccctgtccctcatcatcacggcagatgatggcagcggcggccccctcatgagccccctttccccgcgctctctgtcctcgaacccgtcgtcccgtgactcttcgccgagccgagacccgtcccccgtgtgtggcagcctgcggccccccatcgttatccacagctctggcaagaagtacggcttcagcctgcgggcgatccgcgtctacatgggtgatagcgacgtctacactgtgcaccacgtcgtctggagtgtggaggacggaagccccgcccaggaggcgggcctgcgggctggggacctcatcacccacatcaacggggagtcagtgctggggctggtgcacatggacgtcgtggagctgctgctgaagagcggcaacaagatatccctgcggaccacagccctggagaacacctccatcaaggtgggccccgcccggaagaatgtggccaagggccgcatggcacgcaggagcaagaggagccgtcggcgggagacccaggatcggcggaagtcacttttcaagaagatctccaagcagacctccgtgctgcacaccagccgcagcttctcctccggactccaccactcactgtcatccagtgagagcctccccggctcgcccacccacagcctctcccccagccccaccactccctgccgaagcccagcccctgatgtcccagcagataccactgcatccccacccagcgcatccccgagctccagcagccccgcctccccagctgctgctggccacacccgccccagctccctgcacggcctggctgccaagcttgggccaccccgccccaagactggccgccgcaagtccaccagcagcatcccgccctccccgctggcctgcccgcccatctccgcgcccccaccccgctcgccctcgcccctgcccgggcacccgcccgcacctgcccgatccccgcggctgcgccggggccagtcagctgacaagctgggcacaggggagcggctggatggggaggcggggcggcgcactcgtgggccagaggccgagctcgtggtcatgcggcggctgcacctgtccgagcgccgagactccttcaagaagcaggaggccgtgcaggaggttagcttcgatgagccgcaggaggaggccactgggctgcccacctcagtgccacagatcgccgtggagggcgaggaagccgtgccagtagctctcgggcccaccggaagagactgatcccctgccaggtctctccctggcatcaaagttacgcgttttcttgtgcaatgttttttccgtaaagtcatgcctggatggggactgagccaccagcctgacacccagaaggcgagaagccatctcggtccttgctggaaggtggagacatcgcttgtgttctggtgtcaatcaggggctggatggggcaagaatgggggacaagggtggctttgtaaatagcagcaaatccctgcaactaatttattactttttttttcttttttttttttttttttgagacagagtctcactctgttgcccgggctggagtgcagcggcgtgatctcagctcactgcaacctccgcctcccaagttcaagcgattgtcctgcctcagcttcccaagtggctgggattacaggcgcccaccactatgcccagctaattttttgtatttttagtacagacggggtttcaccatgttggtcaggctggtctcgaactcctgacctcatgatttgcctgcctttgcctcccaaagtgctgggattacaggcgtgagccactgggcccagcctaatttattactttttataagcgatagccgtactgagccgccccctgaaggcggctgccaggtcttgccccaggcacctgggactctgtttgcaggccctgccctctgggctgagaaggatgcactttggacaagtcatctgtgtttgtgttttccagtttttctgtactttttaagtgttttgtgttacctggtctcattcccctccccacacctacccatttgaggggatggagttgaagtcacctggtcacctgtaccggcccagttcggctacaacctggagtgtccgtaaacaattcctctcacccacaaaacaatgtaatcccagcgatggactggattctgaaggccacttcccaccatcatagctgccatgcccaggcagtgcctgctctatatatagagtctgcctccaatcctgctggcttcagcctggagaagggatatgggagctggagctttgatggatgaataggtgttcaccggatctgggcagaggggtcatccgctccccaggtgggcactgataaaggaaggtacaggcctcacctggaactgccaaggcagcctccagaaatgctcggctgtctcggggcacgctccagtatgccagtcctgcgggattacgtccagctacttccagaaacactcagtgtcccctcccctcaggctctgccttggcctggccttgtccagtctaccctggacaagatgccgtgtgtttgaggcccagcagagtaagcccttggccgtgatgtgtctgaaacacctgttaggggttccctccatatgtcagagcctctctgggatgaagttcaagccagaaaacccagtcgaggctcaagtttgaatttcagcttcactgtgtggctctgggaaaatggctttcccactctgtgcctcagtttccttgtgtttacaagactaatcccattgactgtttattaagcacctactgtgtgccaagcgcttttacgtggcttctccctcagccagccttgagaaggctggaggtggtgtcatcacctccattttacagacaaagcagctgagaccccagcgaggggcggagacctgtcccacgatcacccagcaggagtcgtggcagaacggagcatcagccagaccctgttgtgggcgttgtcatcaagggagcttgaatggagggtctggtgtcagatacagccgactccagccccagctcatcccccatgatgctgtgtgacccactgggcactctggtgagggagctttccagacatcaacagcccactctgcttccctttctgagtcccctgtccagcactgcctagtgttggagggtagaccaaggctgtgcatgattcaccccctccttccatcctggagctggcagtgaataaaagcccgtatttacaaagaatgaaaaacaacaaacacaaagaaatgaaaaacaactagaacaaaaacagggcggcgg

SEQ ID NO: 419490 - DNA, 5414 bp, Homo sapiens
cagccccggcccctccctgggctggtgtggaggcccaagttgtggctcctccttcaccccagccctgaccctgcctgagcctagcctctgattcttgtccctcaaccctggctcagatcccccaacatcctcccctggggttggtctcaggtcccatatcacaagccagctgtcttcctttcagcccgggccgtgcaacggggaccttcgacaatgagattgtcatgatgaatcacgtgtaccgggagaggttccccaaggccacagcacagatggagggccgtctgcaggagttcctgacggcctacgcgcccggcgcccggctggcgctggctgatggcgtcttgggcttcatccaccaccagatcgtcgagctggcccgagactgcttggccaagtctggcgagaacctcgtcacctcccgctacttcctagagatgcaggagaagctggagcggcttctgcaggatgcccatgagcgttcggacagtgaggaggtcagcttcatcgtccagcttgtccggaaactgctgatcatcatctcacggccagctcggctgctggagtgtctggagtttgaccctgaggaattttaccacctgctggaggcggctgagggccatgcgcgggagggccaaggcattaagactgaccttccacagtacatcattgggcagctgggcctggccaaggaccccctggaggagatggtgccactgagtcacctcgaagaagaacagcccccagcacctgagtccccagagagccgcgccctggtcggccagtcacggaggaagccatgcgaaagcgactttgagaccatcaaactcattagcaacggagcctatggggccgtctacctggtgcggcaccgtgacacacggcagcgctttgccatcaagaagatcaacaaacagaacttgatcctgcgtaaccagatccagcaggtctttgtggagcgtgacattctcacctttgccgagaacccctttgtggtcagcatgttctgctcctttgagacccggcgccacctatgtatggtcatggaatacgtggaaggcggcgactgcgccacgctcctgaagaacatgggcccgctgcccgtggacatggcccgcctgtacttcgccgagacggtgttggcgctggagtacctgcataactatggcatcgtgcaccgtgacctcaaaccagacaatctgctcatcacctcgcttggccacatcaagctcacggacttcggcctgtccaagatcggcctcatgagcatggccaccaacctctatgagggccacatcgagaaggacgcccgagagttcatcgacaagcaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcgatgagatcatgtggccagagggagatgaggcccttccagcagacgcccaggacctcatcaccaggttgctccggcagagcccgctggaccgtctgggcactggtggcacccacgaagtgaagcagcacccctttttcctggccctggactgggcagggcttctccgacacaaagccgagttcgtgccccagctcgaagccgaggatgataccagctactttgacacacgttcggaacgttaccgccatctgggctccgaggacgacgagaccaatgatgaagaatcgtccacagagatcccccagttctcctcctgctcccaccggttcagcaaggtctacagcagctctgagttcctggccgtccagcccactcctaccttcgctgaaaggagcttcagtgaagaccgggaggaggggtgggagcgcagcgaagtggactatggccgccggctgagtgctgacatccggctgaggtcctggacatcctctggatcctcctgtcagtcatcttcgtcccagcccgagcggggtcccagcccatctctcctgaataccatcagcctggacacaatgcccaagtttgccttctcatcagaggatgagggggtaggcccaggccctgcaggccccaagaggcccgtcttcattctaggggagcctgaccccccaccagcggccaccccagtgatgcccaagccctcgagcctttctgccgacacagctgctctcagccacgcccgcctacggagcaatagcatcggcgcccgacactccacaccaaggcctctggatgccagccggggccgccgccttgggggcccaagagacccagcccctgagaagtccagagcctcctccagcggtggcagtggtggcggcagtgggggccgcgtgcccaagtcagcctctgtctctgccctgtccctcatcatcacggcagatgatggcagcggcggccccctcatgagccccctttccccgcgctctctgtcctcgaacccgtcgtcccgtgactcttcgccgagccgagacccgtcccccgtgtgtggcagcctgcggccccccatcgttatccacagctctggcaagaagtacggcttcagcctgcgggcgatccgcgtctacatgggtgatagcgacgtctacactgtgcaccacgtcgtctggagtgtggaggacggaagccccgcccaggaggcgggcctgcgggctggggacctcatcacccacatcaacggggagtcagtgctggggctggtgcacatggacgtcgtggagctgctgctgaagagcggcaacaagatatccctgcggaccacagccctggagaacacctccatcaaggtgggccccgcccggaagaatgtggccaagggccgcatggcacgcaggagcaagaggagccgtcggcgggagacccaggatcggcggaagtcacttttcaagaagatctccaagcagacctccgtgctgcacaccagccgcagcttctcctccggactccaccactcactgtcatccagtgagagcctccccggctcgcccacccacagcctctcccccagccccaccactccctgccgaagcccagcccctgatgtcccagcagataccactgcatccccacccagcgcatccccgagctccagcagccccgcctccccagctgctgctggccacacccgccccagctccctgcacggcctggctgccaagcttgggccaccccgccccaagactggccgccgcaagtccaccagcagcatcccgccctccccgctggcctgcccgcccatctccgcgcccccaccccgctcgccctcgcccctgcccgggcacccgcccgcacctgcccgatccccgcggctgcgccggggccagtcagctgacaagctgggcacaggggagcggctggatggggaggcggggcggcgcactcgtgggccagaggccgagctcgtggtcatgcggcggctgcacctgtccgagcgccgagactccttcaagaagcaggaggccgtgcaggaggttagcttcgatgagccgcaggaggaggccactgggctgcccacctcagtgccacagatcgccgtggagggcgaggaagccgtgccagtagctctcgggcccaccggaagagactgatcccctgccaggtctctccctggcatcaaagttacgcgttttcttgtgcaatgttttttccgtaaagtcatgcctggatggggactgagccaccagcctgacacccagaaggcgagaagccatctcggtccttgctggaaggtggagacatcgcttgtgttctggtgtcaatcaggggctggatggggcaagaatgggggacaagggtggctttgtaaatagcagcaaatccctgcaactaatttattactttttttttcttttttttttttttttttgagacagagtctcactctgttgcccgggctggagtgcagcggcgtgatctcagctcactgcaacctccgcctcccaagttcaagcgattgtcctgcctcagcttcccaagtggctgggattacaggcgcccaccactatgcccagctaattttttgtatttttagtacagacggggtttcaccatgttggtcaggctggtctcgaactcctgacctcatgatttgcctgcctttgcctcccaaagtgctgggattacaggcgtgagccactgggcccagcctaatttattactttttataagcgatagccgtactgagccgccccctgaaggcggctgccaggtcttgccccaggcacctgggactctgtttgcaggccctgccctctgggctgagaaggatgcactttggacaagtcatctgtgtttgtgttttccagtttttctgtactttttaagtgttttgtgttacctggtctcattcccctccccacacctacccatttgaggggatggagttgaagtcacctggtcacctgtaccggcccagttcggctacaacctggagtgtccgtaaacaattcctctcacccacaaaacaatgtaatcccagcgatggactggattctgaaggccacttcccaccatcatagctgccatgcccaggcagtgcctgctctatatatagagtctgcctccaatcctgctggcttcagcctggagaagggatatgggagctggagctttgatggatgaataggtgttcaccggatctgggcagaggggtcatccgctccccaggtgggcactgataaaggaaggtacaggcctcacctggaactgccaaggcagcctccagaaatgctcggctgtctcggggcacgctccagtatgccagtcctgcgggattacgtccagctacttccagaaacactcagtgtcccctcccctcaggctctgccttggcctggccttgtccagtctaccctggacaagatgccgtgtgtttgaggcccagcagagtaagcccttggccgtgatgtgtctgaaacacctgttaggggttccctccatatgtcagagcctctctgggatgaagttcaagccagaaaacccagtcgaggctcaagtttgaatttcagcttcactgtgtggctctgggaaaatggctttcccactctgtgcctcagtttccttgtgtttacaagactaatcccattgactgtttattaagcacctactgtgtgccaagcgcttttacgtggcttctccctcagccagccttgagaaggctggaggtggtgtcatcacctccattttacagacaaagcagctgagaccccagcgaggggcggagacctgtcccacgatcacccagcaggagtcgtggcagaacggagcatcagccagaccctgttgtgggcgttgtcatcaaggagtacaaggagtgttgacgttgggtcctctaagatcgactataagcagacgtgctc

SEQ ID NO: 419491 - DNA, 991 bp, Homo sapiens
tactctagaggatctcggactacgggggaagggatatgggagctggagctttgatggatgaataggtgttcaccggatctgggcagaggggtcatccgctccccaggtgggcactgataaaggaaggtacaggcctcacctggaactgccaaggcagcctccagaaatgctcggctgtctcggggcacgctccagtatgccagtcctgcgggattacgtccagctacttccagaaacactcagtgtcccctcccctcaggctctgccttggcctggccttgtccagtctaccctggacaagatgccgtgtgtttgaggcccagcagagtaagcccttggccgtgatgtgtctgaaacacctgttaggggttccctccatatgtcagagcctctctgggatgaagttcaagccagaaaacccagtcgaggctcaagtttgaatttcagcttcactgtgtggctctgggaaaatggctttcccactctgtgcctcagtttccttgtgtttacaagactaatcccattgactgtttattaagcacctactgtgtgccaagcgcttttacgtggcttctccctcagccagccttgagaaggctggaggtggtgtcatcacctccattttacagacaaagcagctgagaccccagcgaggggcggagacctgtcccacgatcacccagcaggagtcgtggcagaacggagcatcagccagaccctgttgtgggcgttgtcatcaagggagcttgaatggagggtctggtgtcagatacagccgactccagccccagctcatcccccatgatgctgtgtgacccactgggcactctggtgagggagctttccagacatcaacagcccactctgcttccctttctgagtcccctgtccagcactgcctagtgttggagggtagaccaaggctgtgcatgattcaccccctccttccatcctggagctggcagtgaataaaagcccgtatttacaaaga

SEQ ID NO: 419492 - DNA, 2728 bp, Homo sapiens
cagccccggcccctccctgggctggtgtggaggcccaagttgtggctcctccttcaccccagccctgaccctgcctgagcctagcctctgattcttgtccctcaaccctggctcagatcccccaacatcctcccctggggttggtctcaggtcccatatcacaagccagctgtcttcctttcagcccgggccgtgcaacggggaccttcgacaatgagattgtcatgatgaatcacgtgtaccgggagaggttccccaaggccacagcacagatggagggccgtctgcaggagttcctgacggcctacgcgcccggcgcccggctggcgctggctgatggcgtcttgggcttcatccaccaccagatcgtcgagctggcccgagactgcttggccaagtctggcgagaacctcgtcacctcccgctacttcctagagatgcaggagaagctggagcggcttctgcaggatgcccatgagcgttcggacagtgaggaggtcagcttcatcgtccagcttgtccggaaactgctgatcatcatctcacggccagctcggctgctggagtgtctggagtttgaccctgaggaattttaccacctgctggaggcggctgagggccatgcgcgggagggccaaggcattaagactgaccttccacagtacatcattgggcagctgggcctggccaaggaccccctggaggagatggtgccactgagtcacctcgaagaagaacagcccccagcacctgagtccccagagagccgcgccctggtcggccagtcacggaggaagccatgcgaaagcgactttgagaccatcaaactcattagcaacggagcctatggggccgtctacctggtgcggcaccgtgacacacggcagcgctttgccatcaagaagatcaacaaacagaacttgatcctgcgtaaccagatccagcaggtctttgtggagcgtgacattctcacctttgccgagaacccctttgtggtcagcatgttctgctcctttgagacccggcgccacctatgtatggtcatggaatacgtggaaggcggcgactgcgccacgctcctgaagaacatgggcccgctgcccgtggacatggcccgcctgtacttcgccgagacggtgttggcgctggagtacctgcataactatggcatcgtgcaccgtgacctcaaaccagacaatctgctcatcacctcgcttggccacatcaagctcacggacttcggcctgtccaagatcggcctcatgagcatggccaccaacctctatgagggccacatcgagaaggacgcccgagagttcatcgacaagcaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcgatgagatcatgtggccagagggagatgaggcccttccagcagacgcccaggacctcatcaccaggttgctccggcagagcccgctggaccgtctgggcactggtggcacccacgaagtgaagcagcacccctttttcctggccctggactgggcagggcttctccgacacaaagccgagttcgtgccccagctcgaagccgaggatgataccagctactttgacacacgttcggaacgttaccgccatctgggctccgaggacgacgagaccaatgatgaagaatcgtccacagagatcccccagttctcctcctgctcccaccggttcagcaaggtctacagcagctctgagttcctggccgtccagcccactcctaccttcgctgaaaggagcttcagtgaagaccgggaggaggggtgggagcgcagcgaagtggactatggccgccggctgagtgctgacatccggctgaggtcctggacatcctctggatcctcctgtcagtcatcttcgtcccagcccgagcggggtcccagcccatctctcctgaataccatcagcctggacacaatgcccaagtttgccttctcatcagaggatgagggggtaggcccaggccctgcaggccccaagaggcccgtcttcattctaggggagcctgaccccccaccagcggccaccccagtgatgcccaagccctcgagcctttctgccgacacagctgctctcagccacgcccgcctacggagcaatagcatcggcgcccgacactccacaccaaggcctctggatgccagccggggccgccgccttgggggcccaagagacccagcccctgagaagtccagagcctcctccattttacagacaaagcagctgagaccccagcgaggggcggagacctgtcccacgatcacccagcaggagtcgtggcagaacggagcatcagccagaccctgttgtgggcgttgtcatcaagggagcttgaatggagggtctggtgtcagatacagccgactccagccccagctcatcccccatgatgctgtgtgacccactgggcactctggtgagggagctttccagacatcaacagcccactctgcttccctttctgagtcccctgtccagcactgcctagtgttggagggtagaccaaggctgtgcatgattcaccccctccttccatcctggagctggcagtgaataaaagcccgtatttacaaaga

SEQ ID NO: 419493 - DNA, 3681 bp, Homo sapiens
cagccccggcccctccctgggctggtgtggaggcccaagttgtggctcctccttcaccccagccctgaccctgcctgagcctagcctctgattcttgtccctcaaccctggctcagatcccccaacatcctcccctggggttggtctcaggtcccatatcacaagccagctgtcttcctttcagcccgggccgtgcaacggggaccttcgacaatgagattgtcatgatgaatcacgtgtaccgggagaggttccccaaggccacagcacagatggagggccgtctgcaggagttcctgacggcctacgcgcccggcgcccggctggcgctggctgatggcgtcttgggcttcatccaccaccagatcgtcgagctggcccgagactgcttggccaagtctggcgagaacctcgtcacctcccgctacttcctagagatgcaggagaagctggagcggcttctgcaggatgcccatgagcgttcggacagtgaggaggtcagcttcatcgtccagcttgtccggaaactgctgatcatcatctcacggccagctcggctgctggagtgtctggagtttgaccctgaggaattttaccacctgctggaggcggctgagggccatgcgcgggagggccaaggcattaagactgaccttccacagtacatcattgggcagctgggcctggccaaggaccccctggaggagatggtgccactgagtcacctcgaagaagaacagcccccagcacctgagtccccagagagccgcgccctggtcggccagtcacggaggaagccatgcgaaagcgactttgagaccatcaaactcattagcaacggagcctatggggccgtctacctggtgcggcaccgtgacacacggcagcgctttgccatcaagaagatcaacaaacagaacttgatcctgcgtaaccagatccagcaggtctttgtggagcgtgacattctcacctttgccgagaacccctttgtggtcagcatgttctgctcctttgagacccggcgccacctatgtatggtcatggaatacgtggaaggcggcgactgcgccacgctcctgaagaacatgggcccgctgcccgtggacatggcccgcctgtacttcgccgagacggtgttggcgctggagtacctgcataactatggcatcgtgcaccgtgacctcaaaccagacaatctgctcatcacctcgcttggccacatcaagctcacggacttcggcctgtccaagatcggcctcatgagcatggccaccaacctctatgagggccacatcgagaaggacgcccgagagttcatcgacaagcaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcgatgagatcatgtggccagagggagatgaggcccttccagcagacgcccaggacctcatcaccaggttgctccggcagagcccgctggaccgtctgggcactggtggcacccacgaagtgaagcagcacccctttttcctggccctggactgggcagggcttctccgacacaaagccgagttcgtgccccagctcgaagccgaggatgataccagctactttgacacacgttcggaacgttaccgccatctgggctccgaggacgacgagaccaatgatgaagaatcgtccacagagatcccccagttctcctcctgctcccaccggttcagcaaggtctacagcagctctgagttcctggccgtccagcccactcctaccttcgctgaaaggagcttcagtgaagaccgggaggaggggtgggagcgcagcgaagtggactatggccgccggctgagtgctgacatccggctgaggtcctggacatcctctggatcctcctgtcagtcatcttcgtcccagcccgagcggggtcccagcccatctctcctgaataccatcagcctggacacaatgcccaagtttgccttctcatcagaggatgagggggtaggcccaggccctgcaggccccaagaggcccgtcttcattctaggggagcctgaccccccaccagcggccaccccagtgatgcccaagccctcgagcctttctgccgacacagctgctctcagccacgcccgcctacggagcaatagcatcggcgcccgacactccacaccaaggcctctggatgccagccggggccgccgccttgggggcccaagagacccagcccctgagaagtccagagcctcctccagcggtggcagtggtggcggcagtgggggccgcgtgcccaagtcagcctctgtctctgccctgtccctcatcatcacggcagatgatggcagcggcggccccctcatgagccccctttccccgcgctctctgtcctcgaacccgtcgtcccgtgactcttcgccgagccgagacccgtcccccgtgtgtggcagcctgcggccccccatcgttatccacagctctggcaagaagtacggcttcagcctgcgggcgatccgcgtctacatgggtgatagcgacgtctacactgtgcaccacgtcgtctggagtgtggaggacggaagccccgcccaggaggcgggcctgcgggctggggacctcatcacccacatcaacggggagtcagtgctggggctggtgcacatggacgtcgtggagctgctgctgaagagcggcaacaagatatccctgcggaccacagccctggagaacacctccatcaaggtgggccccgcccggaagaatgtggccaagggccgcatggcacgcaggagcaagaggagccgtcggcgggagacccaggatcggtgcgcggcagtgaccaccagggagcggcggaagtcacttttcaagaagatctccaagcagacctccgtgctgcacaccagccgcagcttctcctccggactccaccactcactgtcatccagtgagagcctccccggctcgcccacccacagcctctcccccagccccaccactccctgccgaagcccagcccctgatgtcccagcagataccacatgcagtaccgccacccaagcgcatcccccgaagcatccaagtcaggcaacggccatcaccagagacatgcttgctggcgcacagaccgaccaagctctccgtgccacagcacatggccctgcaagcatagcgcggcacaaccaccaaccacgcagagggccagccaagacgtctcacaaacagcacatcgcgcgactatctaccatcaaaacccgagctctcaatatccaaccccacagcgaactacaccgctacccggctccgtgccgcgctccacaaatcgagcggaccagaccagccacatcgcactccccgatcctcactcacagcgagctctgacgcgcaacgcaccaccaacgcagccagacagcgcatgagtcacagtcgcgccatcccgcacaagcccacacatatcgatacttcaagctgctcccagcgcacgcaccaacaaccgacccaaaccagtagacgtcacccctccacgactccgcccgaaaaccaatcacacaatcgcgacaccacagcctgctcgcacgca

SEQ ID NO: 419494 - DNA, 690 bp, Homo sapiens
catagcaagaccttatgtctacaaaaaaaaccttagctgggtgtggtggtgtgcacctgtagttccagctacttgggaggctgagcaggaggatcgctagggcccaggagttggaggcagagctctgcccatctcaggcggagccaaggtctagggcagaaggggaggccaggcaccccagccccccagctctgagcacactcctaacctgcccacagtctgctcatcacctcgcttggccacatcaagctcacggacttcggcctgtccaagatcggcctcatgagcatggccaccaacctctatgagggccacatcgagaaggacgcccgagagttcatcgacaagcaggtgggcgggcaggtgggtgggcagccccgggatgcctcctcctctctcctgggacctctcttgggctgggggctggcctcagtttccccgttctccctggcccaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcggtgcgtttcctccacgggcctgggtttgagctgcagccccaccagagctctgggcagcggtcctccac

SEQ ID NO: 419495 - DNA, 448 bp, Homo sapiens
agggggcctgtgtctcatcccgtcttcacaggctcaaggctcagagcctaagtttgatcatgactgagcacttcagagccagggcagcccactggcccttctagaaggttcctaagtcattgcttcatccagcctcccggatgtggcttcatgacagtgtcatgagagctggtcaggggaggcactgcatccccagcctggggtgagaactctagaggcctcaggaaattgctgggtgatgcagggtgaggcagggaggctccagctgagcctcctccctcatcttgcagagatggtgccactgagtcacctcgaagaagaacagcccccagcacctgagtccccagaggtgagtagcagaggctgggggacccccgctcatcttgttctttccagagtggaccaggcacccgcagaaagggctgggtttgccgaggtcttgcatgta

SEQ ID NO: 419496 - DNA, 414 bp, Homo sapiens
  misc_feature (137)..(137): n is a, c, g, or t
  misc_feature (150)..(150): n is a, c, g, or t
gatcttgctctgttctctttgaccttcctgctcttccctttgcaggtgctctttttgaaggtgtctcaaagttaccaccgctgctgtaacgaggctgcctgaagtcatccacaggcgaagttaatggaagctcctgnaccacttcagganccctaataaaaacaggcatcattgttcagtacactacagccctttgccagtgcactgtaatcacagagcacagccataataaacaccagcagacatctgcacgcaggtgcactcacgcgaggacttcagatgttcaacactgagcagatgcctcgttttctgcattcaatttgacagcagttcagagtcctctaatacacacaagtagtaggttccaatttaaaggggagtagccatttttataccttctaagtacaatggatc

SEQ ID NO: 419497 - DNA, 1158 bp, Homo sapiens
aggccgcgctctaggggctggactcagggcggtttgaaagatcggcgcgcaccgcaggagcaacggttggtcctgcggctgtgatgtcggtgttgaggcccctggacaagctgcccggcctgaacacggccaccatcttgctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtgctgggcgggagagccactgcagcattcaccggcacaccgtggtgaagctggcccacacctatcaaagccccctgctctactgtgacctggaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatcactggtctcattcaccactttgactttgtagatgaggaaactgactcagaacaattaagagtagggcagggtgggccaggtgcagaggctcacgcctgtaatcccagcactttgggaggccgaggtgggtggatcacttgaagtcaggaattcgagaccatcctggccaacatggtgtatccctgtctctacaaaaatacaaaaattagccaga

SEQ ID NO: 419498 - DNA, 904 bp, Homo sapiens
gtcaggctctggatgtctccggaggttgtttgaaggattgggcaagctgaggcagttggaagctactctgaggtgtggcatgaatgagggcgtggctgtggtgggcagtggtgacctgagctacccccaagtatccgcccccagccctgctctggcagcccctgcagctgctctgggtaagggagcagggccagcattctatctcactgctgttctctgctctccccgcaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatcactggtctcattcaccactttgactttgtagatgaggaaactgactcagaacaattaagagtagggcagggtgggccaggtgcagaggctcacgcctgtaatcccagcactttgggaggccgaggtgggtggatcacttgaagtcaggaattcgagaccatcctggccaacatggtgtatccctgtctctacaaaaatacaaaaattagccaga

SEQ ID NO: 419499 - DNA, 827 bp, Homo sapiens
  misc_feature (751)..(751): n is a, c, g, or t
  misc_feature (758)..(758): n is a, c, g, or t
aggccgcgctctaggggctggactcagggcggtttgaaagatcggcgcgcaccgcaggagcaacggttggtcctgcggctgtgatgtcggtgttgaggcccctggacaagctgcccggcctgaacacggccaccatcttgctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtgctgggcgggagagccactgcagcattcaccggcacaccgtggtgaagctggcccacacctatcaaagccccctgctctactgtgacctggaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagccgcgggtggaggtcctgcgtncgtgtgncggaagctggaacgcgggggcctggggaagtgccctctccatccctgtggcggttccagcgggtaccca

SEQ ID NO: 419500 - DNA, 993 bp, Homo sapiens
aggccgcgctctaggggctggactcagggcggtttgaaagatcggcgcgcaccgcaggagcaacggttggtcctgcggctgtgatgtcggtgttgaggcccctggacaagctgcccggcctgaacacggccaccatcttgctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtgctgggcgggagagccactgcagcattcaccggcacaccgtggtgaagctggcccacacctatcaaagccccctgctctactgtgacctggaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaagttaacatcacaccaaacaaaacaccagagctcattattagggcggaaaaaggtatacacg

SEQ ID NO: 419501 - DNA, 1248 bp, Homo sapiens
ggtgggagcgagggtcgggtagtagagagtgcggtgcccacaggcctgcagcgggtccaaacctcaggcccccagcccgtgccgcttcgcggggtccacttctcgggaaatgtcctccgagccgcctgctggcggtgtcccgatccccccgggagtgggtcgaagggccaggccctccccagggggtgctgtgcctagggctcgactgtccgctctctctccctgcgcagctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtgctgggcgggagagccactgcagcattcaccggcacaccgtggtgaagctggcccacacctatcaaagccccctgctctactgtgacctggaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatcactggtctcattcaccactttgactttgtagatgaggaaactgactcagaacaattaagagtagggcagggtgggccaggtgcagaggctcacgcctgtaatcccagcactttgggaggccgaggtgggtggatcacttgaagtcaggaattcgagaccatcctggccaacatggtgtatccctgtctctacaaaaatacaaaaattagccaga

SEQ ID NO: 419502 - DNA, 1066 bp, Homo sapiens
aggccgcgctctaggggctggactcagggcggtttgaaagatcggcgcgcaccgcaggagcaacggttggtcctgcggctgtgatgtcggtgttgaggcccctggacaagctgcccggcctgaacacggccaccatcttgctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatcactggtctcattcaccactttgactttgtagatgaggaaactgactcagaacaattaagagtagggcagggtgggccaggtgcagaggctcacgcctgtaatcccagcactttgggaggccgaggtgggtggatcacttgaagtcaggaattcgagaccatcctggccaacatggtgtatccctgtctctacaaaaatacaaaaattagccaga

SEQ ID NO: 419503 - DNA, 1155 bp, Homo sapiens
ggtgggagcgagggtcgggtagtagagagtgcggtgcccacaggcctgcagcgggtccaaacctcaggcccccagcccgtgccgcttcgcggggtccacttctcgggaaatgtcctccgagccgcctgctggcggtgtcccgatccccccgggagtgggtcgaagggccaggccctccccagggggtgctgtgcctagggctcgactgtccgctctctctccctgcgcagctggtgggcacggaggatgctcttctgcagcagctggcggactcgatgctcaaagaggactgcgcctccgagctgaaggttctccagaacacagaggagtccctgcgccatgtggatgccagcttcttcttggggaaggtgtgtttcctcgccacaggtgctgggcgggagagccactgcagcattcaccggcacaccgtggtgaagctggcccacacctatcaaagccccctgctctactgtgacctggaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatcactggtctcattcaccactttgactttgtagatgaggaaactgactcagaacaattaagagtagggcagggtgggccaggtgcagaggctcacgcctgtaatcccagcactttgggaggccgaggtgggtggatcacttgaagtcaggaattcgagaccatcctggccaacatggtgtatccctgtctctacaaaaatacaaaaattagccaga

SEQ ID NO: 419504 - DNA, 1156 bp, Homo sapiens
ggtgggagcgagggtcgggtagtagagagtgcggtgcccacaggcctgcagcgggtccaaacctcaggcccccagcccgtgccgcttcgcggggtccacttctcgggaaatgtcctccgagccgcctgctggcggtgtcccgatccccccgggagtgggtcgaagggccaggccctccccagggggtgctgtgcctagggctcgactgtccgctctctctccctgcgcagctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatcactggtctcattcaccactttgactttgtagatgaggaaactgactcagaacaattaagagtagggcagggtgggccaggtgcagaggctcacgcctgtaatcccagcactttgggaggccgaggtgggtggatcacttgaagtcaggaattcgagaccatcctggccaacatggtgtatccctgtctctacaaaaatacaaaaattagccaga

SEQ ID NO: 419505 - DNA, 901 bp, Homo sapiens
aggccgcgctctaggggctggactcagggcggtttgaaagatcggcgcgcaccgcaggagcaacggttggtcctgcggctgtgatgtcggtgttgaggcccctggacaagctgcccggcctgaacacggccaccatcttgctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaagttaacatcacaccaaacaaaacaccagagctcattattagggcggaaaaaggtatacacg

SEQ ID NO: 419506 - DNA, 699 bp, Homo sapiens
aggccgcgctctaggggctggactcagggcggtttgaaagatcggcgcgcaccgcaggagcaacggttggtcctgcggctgtgatgtcggtgttgaggcccctggacaagctgcccggcctgaacacggccaccatcttgctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtggtaagtacgttcctcgcctgttactgcccacccccagccaagggaaagctggggcggccgtaggcttcttgctgaggcaccctgggtgatggaaagagcatgtattttacacacactggggcctatcggagggtggagggcaggaagaaggagaagatctggaaaaataactaatgggtactaggcttaatacctgggtgacaatgatctgtacaacaaaccccatgacacaagttttaactacataacaaatctgcacatgtacccctgaacttaaaataaaagttaaatttaaaaaccgaaaga

SEQ ID NO: 419507 - DNA, 479 bp, Homo sapiens
caggacagggaagtgtttatgcatgaggatgtgacaaaggcttagtctccagcaaggcgtggtcataacagtcaagaaatgtcattactcgctctgggactgcactgtcatccaccatagcctccttggtcggaaagtctgtagccccctcccactcccacactcactcttgcagagcctgtgtctttaagcagctggcgtgttacatctccatttaaggtttcctttgaacaaaaggtctgtggctaaaaaaagtttaaaaatcactggtctcattcaccactttgactttgtagatgaggaaactgactcagaacaattaagagtagggcagggtgggccaggtgcagaggctcacgcctgtaatcccagcactttgggaggccgaggtgggtggatcacttgaagtcaggaattcgagaccatcctggccaacatggtgtatccctgtctctacaaaaatacaaaaattagccaga

SEQ ID NO: 419508 - DNA, 1845 bp, Homo sapiens
agatatagggaaggaagggaagtaagcagtcacagacgctggcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaaaaaaaaa

SEQ ID NO: 419509 - DNA, 1870 bp, Homo sapiens
caacgggaaactattagttactatagaaacgtgcgtaaagcagctgtacggtccgaattttgggatgcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaaaaaaaaa

SEQ ID NO: 419510 - DNA, 1845 bp, Homo sapiens; identical to SEQ ID NO: 419508

SEQ ID NO: 419511 - DNA, 1754 bp, Homo sapiens
agatatagggaaggaagggaagtaagcagtcacagacgctggcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaaaaaaaaa

SEQ ID NO: 419512 - DNA, 1657 bp, Homo sapiens
agatatagggaaggaagggaagtaagcagtcacagacgctggcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaaaaaaaaa

SEQ ID NO: 419513 - DNA, 1511 bp, Homo sapiens
agatatagggaaggaagggaagtaagcagtcacagacgctggcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaaaaaaaaa

SEQ ID NO: 419514 - DNA, 1588 bp, Homo sapiens
caacgggaaactattagttactatagaaacgtgcgtaaagcagctgtacggtccgaattttgggatgcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaacactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaaaaaaaaa

SEQ ID NO: 419515 - DNA, 1600 bp, Homo sapiens
agatatagggaaggaagggaagtaagcagtcacagacgctggcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagtctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaaaaaaaaa

SEQ ID NO: 419516 - DNA, 1652 bp, Homo sapiens
  misc_feature (1345)..(1345): n is a, c, g, or t
  misc_feature (1393)..(1393): n is a, c, g, or t
  misc_feature (1415)..(1415): n is a, c, g, or t
  misc_feature (1544)..(1544): n is a, c, g, or t
  misc_feature (1550)..(1551): n is a, c, g, or t
  misc_feature (1584)..(1585): n is a, c, g, or t
  misc_feature (1645)..(1645): n is a, c, g, or t
agatatagggaaggaagggaagtaagcagtcacagacgctggcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccaggtaagaaagtctctcctcttccatttttgaccccgtccctgccctcaattttgattactggcaggaaatgtggaggaaggggggtgtggcacagacccaatcctaaggccggaggccttcagggtcaggacatagctgccttccctctctcaggcaccttctgaggttgttttggccctctgacacaaaggataatttagatccatctgccttctgcttccagaatccctgggtggtaggatcctgataattaattggcaagaatgaganaggtggaacagaccagccagtctctatgtgtgcttggcatggacatcnaagcacattgaaactagtgcantcaggtgtcggtacactcaattgacatatgtgctatgaggtcgttgcatatgatacgtgtgcatctgatagtgctggaagttaagcttcgatacatcaactgctagtcgactcgacagccactgcggtntccgtnnaactaaactgtttctattggtctacgacacgtnncttctttttcacggttcaattccattgtttttttagggctttggccctcccccttgtatntagcacc

SEQ ID NO: 419517 - DNA, 1136 bp, Homo sapiens
agatatagggaaggaagggaagtaagcagtcacagacgctggcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtttacgaaacacccaggcacatgccagagagcccactttttttgaaaaccccatgggggggccttttctgggggggg

SEQ ID NO: 419518 - DNA, 1588 bp, Homo sapiens; identical to SEQ ID NO: 419514

SEQ ID NO: 419519 - DNA, 1343 bp, Homo sapiens
caacgggaaactattagttactatagaaacgtgcgtaaagcagctgtacggtccgaattttgggatgcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaacactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagtctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaaaaaaaaa

SEQ ID NO: 419520 - DNA, 1278 bp, Homo sapiens
  misc_feature (1184)..(1184): n is a, c, g, or t
  misc_feature (1195)..(1195): n is a, c, g, or t
  misc_feature (1219)..(1219): n is a, c, g, or t
  misc_feature (1273)..(1273): n is a, c, g, or t
agatatagggaaggaagggaagtaagcagtcacagacgctggcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccaggtaagaaagtctctcctcttccatttttgaccccgtccctgccctcaattttgattactggcaggaaatgtggaggaaggtgctttcctttttcagcaacctctgagtngttttgccttntgacacaaagataattagatcatnggcctttgcttcacaaatcctgggtgtagatcttggtattgccaggatgggccnggttg

SEQ ID NO: 419521 - DNA, 878 bp, Homo sapiens
caacgggaaactattagttactatagaaacgtgcgtaaagcagctgtacggtccgaattttgggatgcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaaaaaaaaa

SEQ ID NO: 419522 - DNA, 2125 bp, Homo sapiens
ctggaggggccagcaagtagagtgttggtggcccaagcaaaccagtgttgccaataccattgccaaaagggcctttggatcctggacaaagcttggctgccggcttcatttattcctgctgatggctgagaagcaatctggtcttgccatcccacttgcctggtcccaagtttggttccatttgttaaaaatttgttgtaaactgcatgttttataaaataaatataaatatcgtttgttatttatctcattagagaactgcttagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaactgttactgttcccccaaacaaagtagctcactctggctttggatgaaattcgactgcttaaaaaggaccttggtttaatagaaatgaagaaaacagactcagaaaaaagatttggctctgtctcatttggaagaagctgcaggcttattccccatgcacttgcttcctggctgcaaaccttaatactttgtttctgctgtagaatttgttagcaaacagggagtcctgatcagcacccttctccacatccacatgactggtttttaatgtagcactgtggtatacatgcaaacatccgttcaaaatctgagtcggagctaactaaaatgatctccaccgagcagctaactctggcatcctagcctgttgtccacatgatgtcacctccatggccgtgaagccattaaccaaagacattcctcaagaaagcgcgccaaggcggtagaaggatcaggcaatgatcagtttccatgatcatattacggaattggctccaaggaccttcagaggtcgagtcctggagcg

SEQ ID NO: 419523 - DNA, 843 bp, Homo sapiens
  misc_feature (794)..(794): n is a, c, g, or t
  misc_feature (796)..(797): n is a, c, g, or t
gctagtagggcatgggtgttaatcggccgagggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaactgttactgttcccccaaacaaagtagctcactctggctttggatgaaattcgactgcttaaaaaggaccttggtttaatagaaatgaagaaaacagactcagaaaaaagatttggctctgtctcatttggaagaagctgcaggcttattccccatgcacttgcttcctggctgcaaaccttaatactttgtttctgctgtagaatttgttagcaaacagggagtcctgatcagcacccttctccacatccacatgactggtttttaatgtagcactgtggtatacatgcaaacatccgttcaaaatctgagtcggagctaaaaataaaaaatgaaaaaacagaaataagaataaaanannaacaaaaaaaaaaactccggaaaaaatttccccaaaaccaggaaaa

SEQ ID NO: 419524 - DNA, 1983 bp, Homo sapiens
ctggaggggccagcaagtagagtgttggtggcccaagcaaaccagtgttgccaataccattgccaaaagggcctttggatcctggacaaagcttggctgccggcttcatttattcctgctgatggctgagaagcaatctggtcttgccatcccacttgcctggtcccaagtttggttccatttgttaaaaatttgttgtaaactgcatgttttataaaataaatataaatatcgtttgttatttatctcattagagaactgcttagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaaatgaggtgccgggcacggtggttcatgcctgtagtcccagcactttgggaggctgaggcgggtggattacctgaagttgggagtttgagaccagcctgaccaacatggagaaaccccgtctctactaaaaatacaaaattagctgggcgtggtggcacatgcctgtaatcccaactactcgggaagctgaggcaggagaatcacttgaacccgggaggtggagcttgcggtgagccgagatcgcgccattgcactccagcctgggcaacaagagtgaaactccatctcaaaaaaaatatacgacaacacacaggcattgttccatgcggtacacctcaacctcctttttcttggaaccaaaaaaaacagaaacctctccggggt

SEQ ID NO: 419525 - DNA, 1993 bp, Homo sapiens
ctggaggggccagcaagtagagtgttggtggcccaagcaaaccagtgttgccaataccattgccaaaagggcctttggatcctggacaaagcttggctgccggcttcatttattcctgctgatggctgagaagcaatctggtcttgccatcccacttgcctggtcccaagtttggttccatttgttaaaaatttgttgtaaactgcatgttttataaaataaatataaatatcgtttgttatttatctcattagagaactgcttagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaaatgaggtgccgggcacggtggttcatgcctgtagtcccagcactttgggaggctgaggcgggtggattacctgaagttgggagtttgagaccagcctgaccaacatggagaaaccccgtctctactaaaaatacaaaattagctgggcgtggtggcacatgcctgtaatcccaactactcgggaagctgaggcaggagaatcacttgaacccgggaggtggagcttgcggtgagccgagatcgcgccattgcactccagcctgggcaacaagagtgaaactccatctcaaaaaaaagaacaagattgtcctgggcgtaataactcttttgtcgaccttccaaaaaaaaaaaaaaaaaatttgggggcggcccgaaattttaacacttttgggccggcccagaagaagccgttccaaaacgcaaggggttcccaaacggcggtgaacgggttgttcttgcaaccccg

SEQ ID NO: 419526 - DNA, 2723 bp, Homo sapiens
  misc_feature (2702)..(2702): n is a, c, g, or t
  misc_feature (2704)..(2705): n is a, c, g, or t
  misc_feature (2713)..(2713): n is a, c, g, or t
  misc_feature (2718)..(2718): n is a, c, g, or t
ctggaggggccagcaagtagagtgttggtggcccaagcaaaccagtgttgccaataccattgccaaaagggcctttggatcctggacaaagcttggctgccggcttcatttattcctgctgatggctgagaagcaatctggtcttgccatcccacttgcctggtcccaagtttggttccatttgttaaaaatttgttgtaaactgcatgttttataaaataaatataaatatcgtttgttatttatctcattagagaactgcttagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaagtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419527 - DNA, 2101 bp, Homo sapiens
ctggaggggccagcaagtagagtgttggtggcccaagcaaaccagtgttgccaataccattgccaaaagggcctttggatcctggacaaagcttggctgccggcttcatttattcctgctgatggctgagaagcaatctggtcttgccatcccacttgcctggtcccaagtttggttccatttgttaaaaatttgttgtaaactgcatgttttataaaataaatataaatatcgtttgttatttatctcattagagaactgcttagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaagtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaacgttttaaaaaattataaaatttggtgtttaaactccggca

SEQ ID NO: 419528 - DNA, 2083 bp, Homo sapiens
ctggaggggccagcaagtagagtgttggtggcccaagcaaaccagtgttgccaataccattgccaaaagggcctttggatcctggacaaagcttggctgccggcttcatttattcctgctgatggctgagaagcaatctggtcttgccatcccacttgcctggtcccaagtttggttccatttgttaaaaatttgttgtaaactgcatgttttataaaataaatataaatatcgtttgttatttatctcattagagaactgcttagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaagtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattatgaaaattgaaccaaaaaaaaaaaaggggggcggcaaaaaaccag

SEQ ID NO: 419529 - DNA, 1722 bp, Homo sapiens
  misc_feature (1701)..(1701): n is a, c, g, or t
  misc_feature (1703)..(1704): n is a, c, g, or t
  misc_feature (1712)..(1712): n is a, c, g, or t
  misc_feature (1717)..(1717): n is a, c, g, or t
acccacgcgtccggggtattggccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaagtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419530 - DNA, 2183 bp, Homo sapiens
ctggaggggccagcaagtagagtgttggtggcccaagcaaaccagtgttgccaataccattgccaaaagggcctttggatcctggacaaagcttggctgccggcttcatttattcctgctgatggctgagaagcaatctggtcttgccatcccacttgcctggtcccaagtttggttccatttgttaaaaatttgttgtaaactgcatgttttataaaataaatataaatatcgtttgttatttatctcattagagaactgcttagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaactgttactgttcccccaaacaaagtagctcactctggctttggatgaaattcgactgcttaaaaaggaccttggtttaatagaaatgaagaaaacagactcagaaaaaagatttggctctgtctcatttggaagaagctgcaggcttattccccatgcacttgcttcctggctgcaaaccttaatactttgtttctgctgtagaatttgttagcaaacagggagtcctgatcagcacccttctccacatccacatgactggtttttaatgtagcactgtggtatacatgcaaacatccgttcaaaatctgagtcggagctaaaaataaaaaatgaaaaaacagaaataagaataaaaggtcttatcctcataattaggaaattttaatcgaaaacaacacacatgtacacaaaggtgtatctaataagcaatatataaggcagtgttaagattacagtgctagcctgggcatcatggcaaaacaccaactctacaaaaaaatgcaaaagttagcagtgcatggtggcatgtgcctgtagtgacagctgcttggaaggctgaggtgggaggatcacttgagccca

SEQ ID NO: 419531 - DNA, 2923 bp, Homo sapiens
  misc_feature (2902)..(2902): n is a, c, g, or t
  misc_feature (2904)..(2905): n is a, c, g, or t
  misc_feature (2913)..(2913): n is a, c, g, or t
  misc_feature (2918)..(2918): n is a, c, g, or t
ctggaggggccagcaagtagagtgttggtggcccaagcaaaccagtgttgccaataccattgccaaaagggcctttggatcctggacaaagcttggctgccggcttcatttattcctgctgatggctgagaagcaatctggtcttgccatcccacttgcctggtcccaagtttggttccatttgttaaaaatttgttgtaaactgcatgttttataaaataaatataaatatcgtttgttatttatctcattagagaactgcttagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaagtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419532 - DNA, 3515 bp, Homo sapiens
  misc_feature (3494)..(3494): n is a, c, g, or t
  misc_feature (3496)..(3497): n is a, c, g, or t
  misc_feature (3505)..(3505): n is a, c, g, or t
  misc_feature (3510)..(3510): n is a, c, g, or t
ctggaggggccagcaagtagagtgttggtggcccaagcaaaccagtgttgccaataccattgccaaaagggcctttggatcctggacaaagcttggctgccggcttcatttattcctgctgatggctgagaagcaatctggtcttgccatcccacttgcctggtcccaagtttggttccatttgttaaaaatttgttgtaaactgcatgttttataaaataaatataaatatcgtttgttatttatctcattagagaactgcttagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaactgttactgttcccccaaacaaagtagctcactctggctttggatgaaattcgactgcttaaaaaggaccttggtttaatagaaatgaagaaaacagactcagaaaaaagatttggctctgtctcatttggaagaagctgcaggcttattccccatgcacttgcttcctggctgcaaaccttaataccttctccacatccacatgactggtttttaatgtagcactgtggtatacatgcaaacatccgttcaaaatctgagtcggagctaactgtaatcccagcactcttggaggccaaggcaggcagatcacttgagcacaggagttcgagaccagcctgggcaacatgagcaaaaccccatctcaaaaaacaaacaaacaaacaaaactaattaaaatcaattagggaaagctttttagaataggttgttggagctagatttggaaagaaaagtaaggatataaattactaatgtacagaggtagaagagagtgacccaaggctgaggacatttctaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419533 - DNA, 2006 bp, Homo sapiens
  misc_feature (1957)..(1957): n is a, c, g, or t
  misc_feature (1959)..(1960): n is a, c, g, or t
ctggaggggccagcaagtagagtgttggtggcccaagcaaaccagtgttgccaataccattgccaaaagggcctttggatcctggacaaagcttggctgccggcttcatttattcctgctgatggctgagaagcaatctggtcttgccatcccacttgcctggtcccaagtttggttccatttgttaaaaatttgttgtaaactgcatgttttataaaataaatataaatatcgtttgttatttatctcattagagaactgcttagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaactgttactgttcccccaaacaaagtagctcactctggctttggatgaaattcgactgcttaaaaaggaccttggtttaatagaaatgaagaaaacagactcagaaaaaagatttggctctgtctcatttggaagaagctgcaggcttattccccatgcacttgcttcctggctgcaaaccttaatactttgtttctgctgtagaatttgttagcaaacagggagtcctgatcagcacccttctccacatccacatgactggtttttaatgtagcactgtggtatacatgcaaacatccgttcaaaatctgagtcggagctaaaaataaaaaatgaaaaaacagaaataagaataaaanannaacaaaaaaaaaaactccggaaaaaatttccccaaaaccaggaaaa

SEQ ID NO: 419534 - DNA, 1657 bp, Homo sapiens
  misc_feature (1636)..(1636): n is a, c, g, or t
  misc_feature (1638)..(1639): n is a, c, g, or t
  misc_feature (1647)..(1647): n is a, c, g, or t
  misc_feature (1652)..(1652): n is a, c, g, or t
gataacctaaatccagtgccagcgttatgtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaagtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419535 - DNA, 3494 bp, Homo sapiens
  misc_feature (3473)..(3473): n is a, c, g, or t
  misc_feature (3475)..(3476): n is a, c, g, or t
  misc_feature (3484)..(3484): n is a, c, g, or t
  misc_feature (3489)..(3489): n is a, c, g, or t
ctggaggggccagcaagtagagtgttggtggcccaagcaaaccagtgttgccaataccattgccaaaagggcctttggatcctggacaaagcttggctgccggcttcatttattcctgctgatggctgagaagcaatctggtcttgccatcccacttgcctggtcccaagtttggttccatttgttaaaaatttgttgtaaactgcatgttttataaaataaatataaatatcgtttgttatttatctcattagagaactgcttagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaactgttactgttcccccaaacaaagtagctcactctggctttggatgaaattcgactgcttaaaaaggaccttggtttaatagaaatgaagaaaacagactcagaaaaaagatttggctctgtctcatttggaagaagctgcaggcttattccccatgcacttgcttcctggctgcaaaccttaatactttgtttctgctgtagaatttgttagcaaacagggagtcctgatcagcacccttctccacatccacatgactggtttttaatgtagcactgtggtatacatgcaaacatccgttcaaaatctgagtcggagctaactgtaatcccagcactcttggaggccaaggcaggcagatcacttgagcacaggagttcgagaccagcctgggcaacatgagcaaaaccccatctcaaaaaacaaacaaacaaacaaaactaattaaaatcaattagggaaagctttttagaataggttgttggagctagatttggaaagaaaagtaaggatataaattactaatgtacagaggtagaagagagtgacccaaggctgaggacatttctaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419536 - DNA, 1903 bp, Homo sapiens
  misc_feature (1882)..(1882): n is a, c, g, or t
  misc_feature (1884)..(1885): n is a, c, g, or t
  misc_feature (1893)..(1893): n is a, c, g, or t
  misc_feature (1898)..(1898): n is a, c, g, or t
gcgaaagagtgagactccgtctcaaaaaaataaataaataaataaaataaaataaatgaaaaccacactaggccaggcacagtggctcacgtctgtaatcccagcactttgggatgccgaggcaggcagatcacctgaggtctggagtttgagaccagcccgaccaacacagagaaaccccatctctactaaaaatacaaaagttagctgggtgtggtggtgcatgcctgtagtcccagctactcaggaggctgaggcaggagaatcacttgaacccaggaggcagaggttgcaataagccgagatggcgccaatgcactccagcctgggcaacaagagcaaaaccccatctcaaaaaacaaacaaacaaacaaaactaattaaaatcaattagggaaagctttttagaataggttgttggagctagatttggaaagaaaagtaaggatataaattactaatgtacagaggtagaagagagtgacccaaggctgaggacatttctaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419537 - DNA, 2180 bp, Homo sapiens
  misc_feature (2159)..(2159): n is a, c, g, or t
  misc_feature (2161)..(2162): n is a, c, g, or t
  misc_feature (2170)..(2170): n is a, c, g, or t
  misc_feature (2175)..(2175): n is a, c, g, or t
agaaggatgaatggaaatcctgggttgatcccattctcctcacaccctaccccctaccctgtcccctgctctcattctctcctcttccaccagcatgcagggctctggtggatgaactagaatgggaaattgcccaggtggaccccaagaagaccattcagatgggatctttccggatcaatccagatggcagccagtcagtggtggaggtaactgttactgttcccccaaacaaagtagctcactctggctttggatgaaattcgactgcttaaaaaggaccttggtttaatagaaatgaagaaaacagactcagaaaaaagatttggctctgtctcatttggaagaagctgcaggcttattccccatgcacttgcttcctggctgcaaaccttaatactttgtttctgctgtagaatttgttagcaaacagggagtcctgatcagcacccttctccacatccacatgactggtttttaatgtagcactgtggtatacatgcaaacatccgttcaaaatctgagtcggagctaactgtaatcccagcactcttggaggccaaggcaggcagatcacttgagcacaggagttcgagaccagcctgggcaacatgagcaaaaccccatctcaaaaaacaaacaaacaaacaaaactaattaaaatcaattagggaaagctttttagaataggttgttggagctagatttggaaagaaaagtaaggatataaattactaatgtacagaggtagaagagagtgacccaaggctgaggacatttctaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419538 - DNA, 1878 bp, Homo sapiens
  misc_feature (1857)..(1857): n is a, c, g, or t
  misc_feature (1859)..(1860): n is a, c, g, or t
  misc_feature (1868)..(1868): n is a, c, g, or t
  misc_feature (1873)..(1873): n is a, c, g, or t
taagccagtgttaagattacagtgctagcctgggcatcatggcaaaacaccaactctacaaaaaaatgcacttgcttcctggctgcaaaccttaatactttgtttctgctgtagaatttgttagcaaacagggagtcctgatcagcacccttctccacatccacatgactggtttttaatgtagcactgtggtatacatgcaaacatccgttcaaaatctgagtcggagctaactgtaatcccagcactcttggaggccaaggcaggcagatcacttgagcacaggagttcgagaccagcctgggcaacatgagcaaaaccccatctcaaaaaacaaacaaacaaacaaaactaattaaaatcaattagggaaagctttttagaataggttgttggagctagatttggaaagaaaagtaaggatataaattactaatgtacagaggtagaagagagtgacccaaggctgaggacatttctaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419539 - DNA, 1462 bp, Homo sapiens
  misc_feature (1441)..(1441): n is a, c, g, or t
  misc_feature (1443)..(1444): n is a, c, g, or t
  misc_feature (1452)..(1452): n is a, c, g, or t
  misc_feature (1457)..(1457): n is a, c, g, or t
tggtgctctcgaggatcgcatgcgcgacgcttcatcaatccagatggcagcagtcagtggtggatggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419540 - DNA, 1951 bp, Homo sapiens
ctggaggggccagcaagtagagtgttggtggcccaagcaaaccagtgttgccaataccattgccaaaagggcctttggatcctggacaaagcttggctgccggcttcatttattcctgctgatggctgagaagcaatctggtcttgccatcccacttgcctggtcccaagtttggttccatttgttaaaaatttgttgtaaactgcatgttttataaaataaatataaatatcgtttgttatttatctcattagagaactgcttagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaactgttactgttcccccaaacaaagtagctcactctggctttggatgaaattcgactgcttaaaaaggaccttggtttaatagaaatgaagaaaacagactcagaaaaaagatttggctctgtctcatttggaagaagctgcaggcttattccccatgcacttgcttcctggctgcaaaccttaatactttgtttctgctgtagaatttgttagcaaacagggagtcctgatcagcacccttctccacatccacatgactggtttttaatgtagcactgtggtatacatgcaaacatccgttcaaaatctgagtcggagctaagtcgacgcggccgcgaatttagtagtagta

SEQ ID NO: 419541 - DNA, 1368 bp, Homo sapiens
  misc_feature (1347)..(1347): n is a, c, g, or t
  misc_feature (1349)..(1350): n is a, c, g, or t
  misc_feature (1358)..(1358): n is a, c, g, or t
  misc_feature (1363)..(1363): n is a, c, g, or t
taggctagtacgaggctcggtggtgaatcggccgaggggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419542 - DNA, 1423 bp, Homo sapiens
  misc_feature (1402)..(1402): n is a, c, g, or t
  misc_feature (1404)..(1405): n is a, c, g, or t
  misc_feature (1413)..(1413): n is a, c, g, or t
  misc_feature (1418)..(1418): n is a, c, g, or t
gctctgtggaacctgacattccctaactcacccatacacccccatcccagaaacctctggtattaggtcaagagctgtcttccatttcccttggcttagggacttggggtgttcctccacattttctgtcagctttcagaatttgtgtccccttgaccctgagatacaggtgagaggacagtggggatgttttatcatttataagcatatattctgcagaatggtggttggtgtgtgtttgtgtcagcttggtctgggaaattttcttgatactggcagatatcagtatgagaatggcatattcctttaaattgtttgccatttgcagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419543 - DNA, 1238 bp, Homo sapiens
  misc_feature (33)..(33): n is a, c, g, or t
  misc_feature (1217)..(1217): n is a, c, g, or t
  misc_feature (1219)..(1220): n is a, c, g, or t
  misc_feature (1228)..(1228): n is a, c, g, or t
  misc_feature (1233)..(1233): n is a, c, g, or t
gcggcccctactactactaaattcgcggccgtncgacaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419544 - DNA, 1204 bp, Homo sapiens
  misc_feature (20)..(20): n is a, c, g, or t
  misc_feature (22)..(22): n is a, c, g, or t
  misc_feature (60)..(60): n is a, c, g, or t
  misc_feature (91)..(91): n is a, c, g, or t
  misc_feature (1183)..(1183): n is a, c, g, or t
  misc_feature (1185)..(1186): n is a, c, g, or t
  misc_feature (1194)..(1194): n is a, c, g, or t
  misc_feature (1199)..(1199): n is a, c, g, or t
gaatgaacctccattgagantnttcttttttttcccccccgaaagaaagggggccttggnacccaaatttgtttaaaaaaaagaccaaacntttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419545 - DNA, 1094 bp, Homo sapiens
  misc_feature (1073)..(1073): n is a, c, g, or t
  misc_feature (1075)..(1076): n is a, c, g, or t
  misc_feature (1084)..(1084): n is a, c, g, or t
  misc_feature (1089)..(1089): n is a, c, g, or t
cctgaggatcccccacactggacactggctctctccactatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419546 - DNA, 1096 bp, Homo sapiens
  misc_feature (1075)..(1075): n is a, c, g, or t
  misc_feature (1077)..(1078): n is a, c, g, or t
  misc_feature (1086)..(1086): n is a, c, g, or t
  misc_feature (1091)..(1091): n is a, c, g, or t
ctactgctcgaattcaagcttctaacgatgtacggggacctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419547 - DNA, 873 bp, Homo sapiens
  misc_feature (852)..(852): n is a, c, g, or t
  misc_feature (854)..(855): n is a, c, g, or t
  misc_feature (863)..(863): n is a, c, g, or t
  misc_feature (868)..(868): n is a, c, g, or t
ggtaccttatattcaagcttaatgtaagggcattccaggcatgaaaagacacacagtttgtacttttggtttggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419548 - DNA, 1839 bp, Homo sapiens
  misc_feature (1818)..(1818): n is a, c, g, or t
  misc_feature (1820)..(1821): n is a, c, g, or t
  misc_feature (1829)..(1829): n is a, c, g, or t
  misc_feature (1834)..(1834): n is a, c, g, or t
gggggaggaggaactaataggcaggtcgaggctgggtgtgtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaagtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419549 - DNA, 3566 bp, Homo sapiens
  misc_feature (3545)..(3545): n is a, c, g, or t
  misc_feature (3547)..(3548): n is a, c, g, or t
  misc_feature (3556)..(3556): n is a, c, g, or t
  misc_feature (3561)..(3561): n is a, c, g, or t
ctggaggggccagcaagtagagtgttggtggcccaagcaaaccagtgttgccaataccattgccaaaagggcctttggatcctggacaaagcttggctgccggcttcatttattcctgctgatggctgagaagcaatctggtcttgccatcccacttgcctggtcccaagtttggttccatttgttaaaaatttgttgtaaactgcatgttttataaaataaatataaatatcgtttgttatttatctcattagagaactgcttagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaactgttactgttcccccaaacaaagtagctcactctggctttggatgaaattcgactgcttaaaaaggaccttggtttaatagaaatgaagaaaacagactcagaaaaaagatttggctctgtctcatttggaagaagctgcaggcttattccccatgcacttgcttcctggctgcaaaccttaatactttgtttctgctgtagaatttgttagcaaacagggagtcctgatcagcacccttctccacatccacatgactggtttttaatgtagcactgtggtatacatgcaaacatccgttcaaaatctgagtcggagctaactgtaatcccagcactcttggaggccaaggcaggcagatcacttgagcacaggagttcgagaccagcctgggcaacatgagcaaaaccccatctcaaaaaacaaacaaacaaacaaaactaattaaaatcaattagggaaagctttttagaataggttgttggagctagatttggaaagaaaagtaaggatataaattactaatgtacagaggtagaagagagtgacccaaggctgaggacatttctaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419550 - DNA, 2091 bp, Homo sapiens
ctggaggggccagcaagtagagtgttggtggcccaagcaaaccagtgttgccaataccattgccaaaagggcctttggatcctggacaaagcttggctgccggcttcatttattcctgctgatggctgagaagcaatctggtcttgccatcccacttgcctggtcccaagtttggttccatttgttaaaaatttgttgtaaactgcatgttttataaaataaatataaatatcgtttgttatttatctcattagagaactgcttagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaagtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggagggggatggacacacgaagggggatggacacacgaagggggatggacacacgaagggggatggacacgcgaagggggatggacacacgaagggggatgaacac

SEQ ID NO: 419551 - DNA, 3722 bp, Homo sapiens
  misc_feature (3701)..(3701): n is a, c, g, or t
  misc_feature (3703)..(3704): n is a, c, g, or t
  misc_feature (3712)..(3712): n is a, c, g, or t
  misc_feature (3717)..(3717): n is a, c, g, or t
ctggaggggccagcaagtagagtgttggtggcccaagcaaaccagtgttgccaataccattgccaaaagggcctttggatcctggacaaagcttggctgccggcttcatttattcctgctgatggctgagaagcaatctggtcttgccatcccacttgcctggtcccaagtttggttccatttgttaaaaatttgttgtaaactgcatgttttataaaataaatataaatatcgtttgttatttatctcattagagaactgcttagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaactgttactgttcccccaaacaaagtagctcactctggctttggatgaaattcgactgcttaaaaaggaccttggtttaatagaaatgaagaaaacagactcagaaaaaagatttggctctgtctcatttggaagaagctgcaggcttattccccatgcacttgcttcctggctgcaaaccttaatactttgtttctgctgtagaatttgttagcaaacagggagtcctgatcagcacccttctccacatccacatgactggtttttaatgtagcactgtggtatacatgcaaacatccgttcaaaatctgagtcggagctaactgtaatcccagcactcttggaggccaaggcaggcagatcacttgagcacaggagttcgagaccagcctgggcaacatgagcaaaaccccatctcaaaaaacaaacaaacaaacaaaactaattaaaatcaattagggaaagctttttagaataggttgttggagctagatttggaaagaaaagtaaggatataaattactaatgtacagaggtagaagagagtgacccaaggctgaggacatttctaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcggtgagctatgggaatcggtagctggttcttggacattaaggggttgttggagaaccaattagaaagttaggctgatatccttgtcctcctctttggaagtgaaggcaagaggcctcttattgccctgtgtcacccatttctcccttgggttggcagtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419552 - DNA, 1421 bp, Homo sapiens
  misc_feature (1400)..(1400): n is a, c, g, or t
  misc_feature (1402)..(1403): n is a, c, g, or t
  misc_feature (1411)..(1411): n is a, c, g, or t
  misc_feature (1416)..(1416): n is a, c, g, or t
ggcggccactctttcatccggtcacatatctcctccagcagctctgtgagggcctctgagcgggcataaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419553 - DNA, 586 bp, Homo sapiens
aagagtggtatcaacgcagacttgccattacggccggtgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaaatgaggtgccgggcacggtggttcatgcctgtagtcccagcactttgggaggctgaggcgggtggattacctgaagttgggagtttgagaccagcctgaccaacatggagaaaccccgtctctactaaaaatacaaaattagctgggcgtggtggcacatgcctgtaatcccaactactcgggaagctgaggcaggagaatcacttgaacccgggaggtggagcttgcggtgagccgagatcgcgccattgcactccagcctgggcaacaagagtgaaactccatctcaaaaaaaatatacgacaacacacaggcattgttccatgcggtacacctcaacctcctttttcttggaaccaaaaaaaacagaaacctctccggggt

SEQ ID NO: 419554 - DNA, 2995 bp, Homo sapiens
  misc_feature (2974)..(2974): n is a, c, g, or t
  misc_feature (2976)..(2977): n is a, c, g, or t
  misc_feature (2985)..(2985): n is a, c, g, or t
  misc_feature (2990)..(2990): n is a, c, g, or t
ctggaggggccagcaagtagagtgttggtggcccaagcaaaccagtgttgccaataccattgccaaaagggcctttggatcctggacaaagcttggctgccggcttcatttattcctgctgatggctgagaagcaatctggtcttgccatcccacttgcctggtcccaagtttggttccatttgttaaaaatttgttgtaaactgcatgttttataaaataaatataaatatcgtttgttatttatctcattagagaactgcttagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaagtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtaaaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagcacattgtcaatctggactataagtctgtccacaattctgtgtgtagagattccagactggggcatagggatgaaaacctaaaggataccttcttttgggaaattctttttttctttttttttctgagatggagtcccgctctgtcgcccaggctggagtacagtggcgcgatctcggctcactacaagctctgcctcccaggttcacgccattatcctgactcagcctcccgagtagctgggattacgggcgcatgccaccacactcagctaatttttgtatttttagtagagacaaggtttcactatgttggccaggtngnncactgcanctggncctaa

SEQ ID NO: 419555 - DNA, 1368 bp, Homo sapiens
taccagttcagaagccgaataacgagataggtgggtgatgcttcagcaattcatcctggcattctggcaggatgaattcctctctgcagttcttctctctatctggccaactgctgtagtgaccactgcctgctgcaatagggaatcttgctttggagagaatcctctatcctgcctccattgcctttgctggtgcctggcttctggcccaagtgttctgtcaaggccagttgtgaattccacatgtcttcttctcaggcactgccactccttatgcctagaggcaggggtggggaggaggagaatgactgttttgtggaaacccccaactcagaaccgcacagatgccctgcagttccacctctgcatggtagccaaagagagtcctctaaatgaagcaatctctttgagcctctcagcatccccgcacttccagcatcactcaacccagaaacaatagaatctacaaggggactccctacatgtttcttatgaggtcagaattgccatcctggaaaggtgagttacagtgctgcccaggtgattcttgtgtgttactctatgttatatctattgtataatctcacatttaaatagcaccattccttttattgcaatgcttatgaaaactttccttgtttttaggtttccttcgtcagtccaggcaggactgtgcggttggaaaagggacggatgctggtcctggaaggggcgtcgttatctagaagctcccaacctaagtgggtgactcatagggagggcaaggagagaaggacacagcaagcaacttacatgtaaaacaagacgtgtgggttattatggaagaaattcacaaccaaacttggggttagcccgtattgttttccaagaactctatgtggacagtgacaaaaaacagacctaagaactagcagactgggcaaagctttttcacataacaacaacaaaaaaagcaattcctcaggaaaaaatggtcaatgggtcattgtgtgtagacaaaactacaagttctgctccagactctggggaaaccatgctgccatcttcaagctgtggccattctgtaatacagactacgctaaatcacatgttgtcatcaaggcagaatattttgttcctttatgggtcagcctgggatacaaaattagagaaactttgcaatgaaaaatcccttgtgtctcattgaactttttccttaattcaaacctttcctttcacagttttgattagtgcctttgcccatgtggacaatattttatgatcaggttttaagagtaatccatccatggctgcttggctgcctggaacttaaaacaacgacaacaacaatgtccagataaacccaataaaataggtttttaaatgtgt

SEQ ID NO: 419556 - DNA, 1261 bp, Homo sapiens
taccagttcagaagccgaataacgagataggtgggtgatgcttcagcaattcatcctggcattctggcaggatgaattcctctctgcagttcttctctctatctggccaactgctgtagtgaccactgcctgctgcaatagggaatcttgctttggagagaatcctctatcctgcctccattgcctttgctggtgcctggcttctggcccaagtgttctgtcaaggccagttgtgaattccacatgtcttcttctcaggcactgccactccttatgcctagaggcaggggtggggaggaggagaatgactgttttgtggaaacccccaactcagaaccgcacagatgccctgcagttccacctctgcatggtagccaaagagagtcctctaaatgaagcaatctctttgagcctctcagcatccccgcacttccagcatcactcaacccagaaacaatagaatctacaaggggactccctacatgtttcttatgaggtcagaattgccatcctggaaaggtgagttacagtgctgcccaggtgattcttgtgtgttactctatgttatatctattgtataatctcacatttaaatagcaccattccttttattgcaatgcttatgaaaactttccttgtttttaggtttccttcgtcagtccaggcaggactgtgcggttggaaaagggacggatgctggtcctggaaggggcgtcgttatctagaagctcccaacctaagtgggtgactcatagggagggcaaggagagaaggacagtgacaaaaaacagacctaagaactagcagactgggcaaagctttttcacataacaacaacaaaaaaagcaattcctcaggaaaaaatggtcaatgggtcattgtgtgtagacaaaactacaagttctgctccagactctggggaaaccatgctgccatcttcaagctgtggccattctgtaatacagactacgctaaatcacatgttgtcatcaaggcagaatattttgttcctttatgggtcagcctgggatacaaaattagagaaactttgcaatgaaaaatcccttgtgtctcattgaactttttccttaattcaaacctttcctttcacagttttgattagtgcctttgcccatgtggacaatattttatgatcaggttttaagagtaatccatccatggctgcttggctgcctggaacttaaaacaacgacaacaacaatgtccagataaacccaataaaataggtttttaaatgtgt

SEQ ID NO: 419557 - DNA, 1230 bp, Homo sapiens
  misc_feature (3)..(3): n is a, c, g, or t
ctnggagcctgttttctcgccatctagtacatccctgtctggagggaggtggttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaacaaaaaacctaaaatactattaaaaaaaataatataaaaattaaacttcccataaatatacaacatcaaaaattctaaaaaactctaccttaccataaacttattccccttcaactaaatactccttttcccacttctcttaatctcttatatccccttaccaatttccttcacaaactcttcaccattctttattaacaaatttcaaaattctccct

SEQ ID NO: 419558 - DNA, 434 bp, Homo sapiens
  misc_feature (391)..(391): n is a, c, g, or t
  misc_feature (403)..(403): n is a, c, g, or t
tctgcatgttgactcatagagagatcccattctaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgatgcctgnaaggggatcctntaagattctacctacacgcatcccgcgtaca

SEQ ID NO: 419559 - DNA, 922 bp, Homo sapiens
  misc_feature (11)..(11): n is a, c, g, or t
  misc_feature (34)..(34): n is a, c, g, or t
gggaaaactanggctaggtacgaggctgggtgtnttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtggctcaatggcctcgaggaatacacggccccgaaccagcaaggactcaatgggtagcacaaggcggccagaagggagggacaggtggacaagaaaaaggggtaaaaggccacaggactagggcggagatacagc

SEQ ID NO: 419560 - DNA, 277 bp, Homo sapiens
atttaaatgtctgataggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcatcaggttacttctggacagctgatggagagcaacgatgcgggcggatcctc

SEQ ID NO: 419561 - DNA, 4271 bp, Homo sapiens
aggcactggaggattgagctaggtgggcagaaaagagcagtgagtgttttgggttttttcactttcaggcttaacgcctcactgctagcacaagccgcccttaataaatcacacttaaaaaggagcttccggggtcgggcgcggtggctcacgcctgtaatcccagcaatttgggaggccgaggcgggcggatcatgaggtcaggagatcgagaccatcctggcttacacggtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtc

SEQ ID NO: 419562 - DNA, 3779 bp, Homo sapiens
  misc_feature (11)..(11): n is a, c, g, or t
  misc_feature (34)..(34): n is a, c, g, or t
gggaaaactanggctaggtacgaggctgggtgtngttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtc

SEQ ID NO: 419563 - DNA, 5118 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419564 - DNA, 5258 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtgagtacaactttgttcatgtagctagttttagaaagtaaaccaaatccacttaactaacttatttttatatgaatttaggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419565 - DNA, 5122 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419566 - DNA, 5218 bp, Homo sapiens
aggcactggaggattgagctaggtgggcagaaaagagcagtgagtgttttgggttttttcactttcaggcttaacgcctcactgctagcacaagccgcccttaataaatcacacttaaaaaggagcttccggggtcgggcgcggtggctcacgcctgtaatcccagcaatttgggaggccgaggcgggcggatcatgaggtcaggagatcgagaccatcctggcttacacggtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419567 - DNA, 3279 bp, Homo sapiens
agcggggtgtggggaaatggtgttctgcgaaccaggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419568 - DNA, 5134 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaatcctaactcccgaccgtaccagcc

SEQ ID NO: 419569 - DNA, 2061 bp, Homo sapiens
aaattcggccattatggccgggtgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419570 - DNA, 1866 bp, Homo sapiens
attaaatggagtggcatcaccaatttcacccttgaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419571 - DNA, 1771 bp, Homo sapiens
ttctttgacgttgtttaatttttaggtctacacttcaaaatctgtgtttgttgcaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419572 - DNA, 1486 bp, Homo sapiens
tttgtgtgttctcagctccactcatttattcattatctacagtaccagatctttgtctttttctggggtagagaagtggggtcacttcaatacaattctgctaattaccatttgttttttcttttcagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419573 - DNA, 1205 bp, Homo sapiens
cgtcgacttttttttcctcctttgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419574 - DNA, 4661 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggacctgctcgcagtgcctgatgccctaaagggatcctctagctcacctgcagc

SEQ ID NO: 419575 - DNA, 4728 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttcttgacgcgtggagtactgaaaatgccaacaggcaaacacccccaaaaggcagctccagagactatccggccacggcgtcggccctcctcccaatccgcaaaaatgtgcagtct

SEQ ID NO: 419576 - DNA, 4341 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgatgatccatgattttgagcacttttttatatgcctgtttgccatttgtatgttgtcttttgagaaatgtctattcagatcttttgcccattaaaaaatttagattattagatttttttcccatagagttgtttgggctccttatatattctgattaattttttatcagatgggtagtttgcaaatattatctcccattcggtgggttgtctctttgatttgttggattgt

SEQ ID NO: 419577 - DNA, 4393 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaacaaaaaacctaaaatactattaaaaaaaataatataaaaattaaacttcccataaatatacaacatcaaaaattctaaaaaactctaccttaccataaacttattccccttcaactaaatactccttttcccacttctcttaatctcttatatccccttaccaatttccttcacaaactcttcaccattctttattaacaaatttcaaaattctccct

SEQ ID NO: 419578 - DNA, 1116 bp, Homo sapiens
tttttctgacagcaatagatttattaagtatccccgaaaatataaacacaaaccagtaaaaaacaaaaccgtaaaacgtcaggcctggagctgcaataagacagagacaggagcagctcacacgtggcctaggtggggaggacgaggccataaatactgcaggagggcggcaagggagccctagggcgaggggaaagcagggtgtcggcagcgagatggctccgggggtttagacactgctggcttcggccccggccgccacctgcctctcactccagctgcgagcagcttcatccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419579 - DNA, 3129 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggtatggtcagttttgctctacgttatttaagatccttctgtgcttaaggcacttttctgggtgcttgggaggattaaaaaataaatatgacatagtgcctgttctcacggaatttataatatggtgggaaacatgaacataataaaaaggtaggtatgtggaaagtgttttggtggaggtacaaagtcctttggaagcacagactgatggaagcaattaattcctgttggaagtctagatccagtttcatggagaaggtggcattttagattggagcaaaattgatgaaggggtatttgcatttgagaggtggtttaagcaagggcccagatggacgaagacatgcaaaatgtacggacatcgtgatcctcacggacatcgtgatcctcacggacatcgtgatcctcacggacatgggtacc

SEQ ID NO: 419580 - DNA, 1032 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggtatagtaacattattttaaaaaattacaaaatggtagttaaaatttagtttaaagttgaaatgaaaaaaaa

SEQ ID NO: 419581 - DNA, 431 bp, Homo sapiens
ccaaggttagatttttcattcataaaattttaaattatacctaagtttttaatatgttaaacaatggtaaactaagatttgcacattttacttgataaattggttgctccagaaatttagtaggatttgtattgtatttttaactaagcctaataataaagagaaaataaaaatttgtggaactgttttttctttttatatgtaggtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactataggtaaaaacatgcagtgagaaaaatgtgtgtattaaaaattgagatagaatttacatactgtaaaattaacc

SEQ ID NO: 419582 - DNA, 535 bp, Homo sapiens
caggtgcacacacaccctgaaggtgggttcaggtgttcagcattattgttcttccagtttctcagattctaggatgctgctaacaaaagcatggcagggactggtttttgttccatgaatccaggggaggggcctgtatgactgccctaaggcttcaccttgcgggagccgcagtcaacaaagcaggctgaggatttaacgttttaccatccttgtgcagtgcaagagaagcttgtcagcctaggatgtctcttaaagtctgtgccacagaccttgttccagatgaggacaggtgtcgggattccgatgacctcacagctcaagtacacctgggcaccagtgacattccagatgtccttggggggcgtcactatggaaggacctgcaggagagggcacaaagccaaagtcatcttttaaacagtccttcacatgagtcagcatcttagggagaaaataataattttgtttatgaggccatccccttgatggattatctgaagcaaatttcaaagaccacactggcttcctcctgc

SEQ ID NO: 419583 - DNA, 265 bp, Homo sapiens
atacttagttctgttctttttaaagcaaatgtactagtcatttttaaatggctgtgagatttattgtgtaccttttttcactggtatttcatgtaaggcatcaaccactgtaatttttgctgatgctgaagcctgtccttgggaattggatgcatggcactcatattctccagcatcttccttacttagaggagatacctgtgaaagaaaaaagatctagtattcctctgtggtggtcttctcttttgtcagtggttccagtgag

SEQ ID NO: 419584 - DNA, 4079 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtc

SEQ ID NO: 419585 - DNA, 3842 bp, Homo sapiens
catgaaatattagcaggcggcccggttggtatttcagtgacgcgggactgggtgctgtagttatacatctctgtgggcaggtggcctcattgcagaggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtc

SEQ ID NO: 419586 - DNA, 5177 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419587 - DNA, 4818 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419588 - DNA, 5122 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaagtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419589 - DNA, 5511 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtgagtacaactttgttcatgtagctagttttagaaagtaaaccaaatccacttaactaacttatttttatatgaatttaggtacgctctgttaggattccacagattggagacaaatttgctagtcgacatggtcaaaagggtacttgtggtattcagtatagacaagaggtaggtatctttgatctccctcatgcccaaaccagttttgttaaatattttttttttaatcaaaatttgctttaacttaagagctcaaagatgatacaggttgaactttttgattttattgttgaataagtatatgaacataccatgtttaaacagaatttgggacatacagtaattcagttgggagaactgaaatgtcagttctagtttagtatatgtatctttgagtcccttttaaaatttttctttgtaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419590 - DNA, 3998 bp, Homo sapiens
aaaaaagcagtggaggctgggtgaatcggccgaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419591 - DNA, 2946 bp, Homo sapiens
tttgtaaacatttaaaaaataaccagtgagaagaggatacctagcatttgttgtttcttctagaaaactcaaacttactttctagttatttattttgacagacacttaaaacctgcttatgcagtgggatggatgggatgttccagggaaatgcaatatctctgctacagtgttgactctgaatagcattgcatgaagtaaaatgtattttgtttcctttgccatcttcctgttactccccttccattgggtggctctgtgtagtagtgaattgatgtccagtggagttaagattgagttaagatgaaatccacaatttctgtgggaggatgtgtacagagggcatccatagatactctctttttaatttaaaaaaatttttctcctgtacccactgatggcagagatattctttctcttgtaatatagaaatcagaagatgacaacagtgctgattccaatgttcttttccttcatagacttttttttttgttttctgtgtggactgtagtattagagttcagaatagtttgtaatatttggaataagggtgtgattcatggtatagagactcctgtggccttctctctgacttggaactgattcatgtatgtggtttttaatctttgttggggattatgtgacattccgtgtctatttcctcacaggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419592 - DNA, 2014 bp, Homo sapiens
  misc_feature (3)..(3): n is a, c, g, or t
ctnggagcctgttttctcgccatctagtacatccctgtctggagggaggtggttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccctccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcg

SEQ ID NO: 419593 - DNA, 4682 bp, Homo sapiens
  misc_feature (4639)..(4639): n is a, c, g, or t
  misc_feature (4651)..(4651): n is a, c, g, or t
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgcccttgatgcctgnaaggggatcctntaagattctacctacacgcatcccgcgtaca

SEQ ID NO: 419594 - DNA, 5148 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcacctgtttaaaaaaaaaaaaagataaaaattagttacatatggggatgtggttgacttttgaattggcaggtagttgagtgtttccaaataaatgaagatgttaaaatatggggataaaggatatatgagtaattgtataaatgatatgctggagtgctctgtggaactcaagttacatgattttagctatgaaaggcaattttgctgtattggttgatgcatcaaaggtacatcttattatagaactggaagagcacatttcacaatgagattcagagaggttaaagacctttcctttgtagtccggatctccttcaaaaggtaaagtggaggaataattagtagcagagctgagactcaaacgcatggcttgactcttagctactgttctgtttcattgcctgacattacacattatggctgaagagaatctgaccaaatacttctttacttaatatttcttttcatatcacagctgagtgatctgcacagtggaatggtttgacacatggtgacggtaaattttgttcttttgtctaagggaaagccaattcagacatcagtttcatagaactatataaatgtaaagtagcactgctatgacacaggatgggttcttcagaggaagctttttggcagtgaaggaaggggaggcagaacagaactgggtatttgccaatatactctcctttgtggccttttcttttaaaagcaaaagtgaagggcgagaattgcccacaatcattttcttttaaataggaatttaatagtcacaacacaaagggaaaatgccaagtagataggtagaaagctatgggaaatagaagccattccaggcaagtttgattttgactcttacatgttagataaggtaaaagcatctaagtcataa

SEQ ID NO: 419595 - DNA, 4648 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttaccttgttccagatgaggacaggtgtcgggattccgatgacctcacagctcaagtacacctgggcaccagtgacattccagatgtccttggggggcgtcactatggaaggaccttgctcgcaggtgccatatgcaagggggccgagctc

SEQ ID NO: 419596 - DNA, 4535 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcaccttttttcactggtatttcatgtaaggcatcaaccactgtaatttttgctgatgctgaagcctgtccttgggaattggatgcatggcactcatattctccagcatcttccttacttagaggagataccagcacccagccagttacttcatgcttttctgggccaccccgggtctgaatggccaggttgtcccggtcaccaggcaggagttctgtcctttgaactccatagtgacccctttttacttgttccctaagcggatcagcgggccgagctcga

SEQ ID NO: 419597 - DNA, 3837 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggtaggtatctttgatctccctcatgcccaaaccagttttgttaaatattttttttttaatcaaaatttgctttaacttaagagctcaaagatgatacaggttgaactttttgattttattgttgaataagtatatgaacataccatgtttaaacagaatttgggacatacagtaattcagttgggagaactgaaatgtcagttctagtttagtatatgtatctttgagtcccttttaaaatttttctttgtaggatatgcctttcacctgtgaaggtatcacccctgatatcatcatcaatccccatgccatcccctctcgtatgactattggtcacttaattgaatgccttcaagggaaggtaagagatgttcttcaaaaatatagattctaagctgatgcttcttctaaaactctgataggtgattgctctcacatttgagccagggtactttgtaaaaagctagtgtgagacttacttttctgctttcaaattgcttatgattctgccattttttttggcaatttgcaaagttatggacaagtcagaatttttgtgagatatactacattcaactaatacttacatatgtgatt

SEQ ID NO: 419598 - DNA, 1181 bp, Homo sapiens
aggcactggaggattgagctaggtgggcagaaaagagcagtgtcgttatttgtgcaacaacattgaaaaacaagcagaaataaaacattgacggaacggatacgaccgcagattgcgggagctgtcctctcaatcggcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtggctcaatggcctcgaggaatacacggccccgaaccagcaaggactcaatgggtagcacaaggcggccagaagggagggacaggtggacaagaaaaaggggtaaaaggccacaggactagggcggagatacagc

SEQ ID NO: 419599 - DNA, 3449 bp, Homo sapiens
ctcgtgccgaattcggcacgagaccgcgtgttcgcgcctggtagagatttctcgaagacaccagtgggcccgtgtggaaccaaacctgcgcgcgtggccgggccgtgggacaacgaggccgcggagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagaccacgagcatcactctgaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaagcaaagaaataaaggagaaaagagaagaatctgagaattggggaggcatagattcttataaaaatcacaaaatttgttgtaaattagaggggagaaatttagaattaagtataaaaaggcagaattagtatagagtacattcattaaacatttttgtcaggattatttcccgtaaaaacgtagtgagcacttttcatatactaatttagttgtacatttaactttgtataatacagaaatctaaatatatttaatgaattcaagcaatatatcacttgaccaagaaattggaatttcaaaatgttcgtgcgggtatataccagatgagtacagtgagtagttttatgtatcaccagactgggttattgccaagttatatatcaccaaaagctgtatgactggatgttctggttacctggtttacaaaattatcagagtagtaaaactttgatatatatgaggatattaaaactacactaagtatcatttgattcgattcagaaagtactttgatatctctcagtgcttcagtgctatcattgtgagcaattgtcttttatatacggtactgtagccatactaggcctgtctgtggcattctctagatgtttcttttttacacaataaattccttatatcagcttga

SEQ ID NO: 419600 - DNA, 2982 bp, Homo sapiens
cgactatagacgatccccagtacgctacatgatcatcactctcaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaagcaaagaaataaaggagaaaagagaagaatctgagaattggggaggcatagattcttataaaaatcacaaaatttgttgtaaattagaggggagaaatttagaattaagtataaaaaggcagaattagtatagagtacattcattaaacatttttgtcaggattatttcccgtaaaaacgtagtgagcacttttcatatactaatttagttgtacatttaactttgtataatacagaaatctaaatatatttaatgaattcaagcaatatatcacttgaccaagaaattggaatttcaaaatgttcgtgcgggtatataccagatgagtacagtgagtagttttatgtatcaccagactgggttattgccaagttatatatcaccaaaagctgtatgactggatgttctggttacctggtttacaaaattatcagagtagtaaaactttgatatatatgaggatattaaaactacactaagtatcatttgattcgattcagaaagtactttgatatctctcagtgcttcagtgctatcattgtgagcaattgtcttttatatacggtactgtagccatactaggcctgtctgtggcattctctagatgtttcttttttacacaataaattccttatatcagcttga

SEQ ID NO: 419601 - DNA, 3521 bp, Homo sapiens
ctcgtgccgaattcggcacgagaccgcgtgttcgcgcctggtagagatttctcgaagacaccagtgggcccgtgtggaaccaaacctgcgcgcgtggccgggccgtgggacaacgaggccgcggagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagaccacgagcatcactctgaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaagcaaagaaataaaggagaaaagagaagaatctgagaattggggaggcatagattcttataaaaatcacaaaatttgttgtaaattagaggggagaaatttagaattaagtataaaaaggcagaattagtatagagtacattcattaaacatttttgtcaggattatttcccgtaaaaacgtagtgagcacttttcatatactaatttagttgtacatttaactttgtataatacagaaatctaaatatatttaatgaattcaagcaatatatcacttgaccaagaaattggaatttcaaaatgttcgtgcgggtatataccagatgagtacagtgagtagttttatgtatcaccagactgggttattgccaagttatatatcaccaaaagctgtatgactggatgttctggttacctggtttacaaaattatcagagtagtaaaactttgatatatatgaggatattaaaactacactaagtatcatttgattcgattcagaaagtactttgatatctctcagtgcttcagtgctatcattgtgagcaattgtcttttatatacggtactgtagccatactaggcctgtctgtggcattctctagatgtttcttttttacacaataaattccttatatcagcttgaaaaaaaaaagttttaagtatgaagaagttagcttatagggatataaaaaaaaacttttaggggggggcccca

SEQ ID NO: 419602 - DNA, 2565 bp, Homo sapiens
ctgtgctttgggacggcggattcgggaactgactgctgtagttcagaagaggttggctttccagagggcagtgttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaagcaaagaaataaaggagaaaagagaagaatctgagaattggggaggcatagattcttataaaaatcacaaaatttgttgtaaattagaggggagaaatttagaattaagtataaaaaggcagaattagtatagagtacattcattaaacatttttgtcaggattatttcccgtaaaaacgtagtgagcacttttcatatactaatttagttgtacatttaactttgtataatacagaaatctaaatatatttaatgaattcaagcaatatatcacttgaccaagaaattggaatttcaaaatgttcgtgcgggtatataccagatgagtacagtgagtagttttatgtatcaccagactgggttattgccaagttatatatcaccaaaagctgtatgactggatgttctggttacctggtttacaaaattatcagagtagtaaaactttgatatatatgaggatattaaaactacactaagtatcatttgattcgattcagaaagtactttgatatctctcagtgcttcagtgctatcattgtgagcaattgtcttttatatacggtactgtagccatactaggcctgtctgtggcattctctagatgtttcttttttacacaataaattccttatatcagcttga

SEQ ID NO: 419603 - DNA, 1504 bp, Homo sapiens
cacgacatatgtatagctcgatcccggtgttaatttcgtcacgagggactagctgtctgttgctatgttactgtcactgacgttgcctcatgaataaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaagcaaagaaataaaggagaaaagagaagaatctgagaattggggaggcatagattcttataaaaatcacaaaatttgttgtaaattagaggggagaaatttagaattaagtataaaaaggcagaattagtatagagtacattcattaaacatttttgtcaggattatttcccgtaaaaacgtagtgagcacttttcatatactaatttagttgtacatttaactttgtataatacagaaatctaaatatatttaatgaattcaagcaatatatcacttgaccaagaaattggaatttcaaaatgttcgtgcgggtatataccagatgagtacagtgagtagttttatgtatcaccagactgggttattgccaagttatatatcaccaaaagctgtatgactggatgttctggttacctggtttacaaaattatcagagtagtaaaactttgatatatatgaggatattaaaactacactaagtatcatttgattcgattcagaaagtactttgatatctctcagtgcttcagtgctatcattgtgagcaattgtcttttatatacggtactgtagccatactaggcctgtctgtggcattctctagatgtttcttttttacacaataaattccttatatcagcttga

SEQ ID NO: 419604 - DNA, 2307 bp, Homo sapiens
ctcgtgccgaattcggcacgagaccgcgtgttcgcgcctggtagagatttctcgaagacaccagtgggcccgtgtggaaccaaacctgcgcgcgtggccgggccgtgggacaacgaggccgcggagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagaccacgagcatcactctgaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtaagtttttaagaagtcttattacattattgaccaacaataaaatagagaaaatattcggtaaagcctcatt

SEQ ID NO: 419605 - DNA, 2213 bp, Homo sapiens
  misc_feature (2192)..(2192): n is a, c, g, or t
ctcgtgccgaattcggcacgagaccgcgtgttcgcgcctggtagagatttctcgaagacaccagtgggcccgtgtggaaccaaacctgcgcgcgtggccgggccgtgggacaacgaggccgcggagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagaccacgagcatcactctgaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgantggtttagggtaccgagctcg

SEQ ID NO: 419606 - DNA, 2046 bp, Homo sapiens
ctcgtgccgaattcggcacgagaccgcgtgttcgcgcctggtagagatttctcgaagacaccagtgggcccgtgtggaaccaaacctgcgcgcgtggccgggccgtgggacaacgaggccgcggagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagaccacgagcatcactctgaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattgctgctgcttttaactgaaggcttatcaacgtggttttaagtaactcgttcccttgtgttgttcaactcgcgggatcctcagagt

SEQ ID NO: 419607 - DNA, 3398 bp, Homo sapiens
cgctgttgctgtggctgcctagagatcccccatgttgccagacgtggtcgggccgtgggacaacgaggcgcggagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagaccacgagcatcactctgaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaagcaaagaaataaaggagaaaagagaagaatctgagaattggggaggcatagattcttataaaaatcacaaaatttgttgtaaattagaggggagaaatttagaattaagtataaaaaggcagaattagtatagagtacattcattaaacatttttgtcaggattatttcccgtaaaaacgtagtgagcacttttcatatactaatttagttgtacatttaactttgtataatacagaaatctaaatatatttaatgaattcaagcaatatatcacttgaccaagaaattggaatttcaaaatgttcgtgcgggtatataccagatgagtacagtgagtagttttatgtatcaccagactgggttattgccaagttatatatcaccaaaagctgtatgactggatgttctggttacctggtttacaaaattatcagagtagtaaaactttgatatatatgaggatattaaaactacactaagtatcatttgattcgattcagaaagtactttgatatctctcagtgcttcagtgctatcattgtgagcaattgtcttttatatacggtactgtagccatactaggcctgtctgtggcattctctagatgtttcttttttacacaataaattccttatatcagcttga

SEQ ID NO: 419608 - DNA, 2575 bp, Homo sapiens
  misc_feature (15)..(15): n is a, c, g, or t
cttttggtgattttnactgctttgtttctttcagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaagcaaagaaataaaggagaaaagagaagaatctgagaattggggaggcatagattcttataaaaatcacaaaatttgttgtaaattagaggggagaaatttagaattaagtataaaaaggcagaattagtatagagtacattcattaaacatttttgtcaggattatttcccgtaaaaacgtagtgagcacttttcatatactaatttagttgtacatttaactttgtataatacagaaatctaaatatatttaatgaattcaagcaatatatcacttgaccaagaaattggaatttcaaaatgttcgtgcgggtatataccagatgagtacagtgagtagttttatgtatcaccagactgggttattgccaagttatatatcaccaaaagctgtatgactggatgttctggttacctggtttacaaaattatcagagtagtaaaactttgatatatatgaggatattaaaactacactaagtatcatttgattcgattcagaaagtactttgatatctctcagtgcttcagtgctatcattgtgagcaattgtcttttatatacggtactgtagccatactaggcctgtctgtggcattctctagatgtttcttttttacacaataaattccttatatcagcttga

SEQ ID NO: 419609 - DNA, 2026 bp, Homo sapiens
agaaggtgtaaaaaagcatcaccactcaaagtcccaacggccagtgccacaaggaaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaagcaaagaaataaaggagaaaagagaagaatctgagaattggggaggcatagattcttataaaaatcacaaaatttgttgtaaattagaggggagaaatttagaattaagtataaaaaggcagaattagtatagagtacattcattaaacatttttgtcaggattatttcccgtaaaaacgtagtgagcacttttcatatactaatttagttgtacatttaactttgtataatacagaaatctaaatatatttaatgaattcaagcaatatatcacttgaccaagaaattggaatttcaaaatgttcgtgcgggtatataccagatgagtacagtgagtagttttatgtatcaccagactgggttattgccaagttatatatcaccaaaagctgtatgactggatgttctggttacctggtttacaaaattatcagagtagtaaaactttgatatatatgaggatattaaaactacactaagtatcatttgattcgattcagaaagtactttgatatctctcagtgcttcagtgctatcattgtgagcaattgtcttttatatacggtactgtagccatactaggcctgtctgtggcattctctagatgtttcttttttacacaataaattccttatatcagcttga

SEQ ID NO: 419610 - DNA, 3433 bp, Homo sapiens
ctcgtgccgaattcggcacgagaccgcgtgttcgcgcctggtagagatttctcgaagacaccagtgggcccgtgtggaaccaaacctgcgcgcgtggccgggccgtgggacaacgaggccgcggagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagaccacgagcatcactctgaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccacttaatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaagcaaagaaataaaggagaaaagagaagaatctgagaattggggaggcatagattcttataaaaatcacaaaatttgttgtaaattagaggggagaaatttagaattaagtataaaaaggcagaattagtatagagtacattcattaaacatttttgtcaggattatttcccgtaaaaacgtagtgagcacttttcatatactaatttagttgtacatttaactttgtataatacagaaatctaaatatatttaatgaattcaagcaatatatcacttgaccaagaaattggaatttcaaaatgttcgtgcgggtatataccagatgagtacagtgagtagttttatgtatcaccagactgggttattgccaagttatatatcaccaaaagctgtatgactggatgttctggttacctggtttacaaaattatcagagtagtaaaactttgatatatatgaggatattaaaactacactaagtatcatttgattcgattcagaaagtactttgatatctctcagtgcttcagtgctatcattgtgagcaattgtcttttatatacggtactgtagccatactaggcctgtctgtggcattctctagatgtttcttttttacacaataaattccttatatcagcttga

SEQ ID NO: 419611 - DNA, 2291 bp, Homo sapiens
ctcgtgccgaattcggcacgagaccgcgtgttcgcgcctggtagagatttctcgaagacaccagtgggcccgtgtggaaccaaacctgcgcgcgtggccgggccgtgggacaacgaggccgcggagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagaccacgagcatcactctgaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccacttaatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtaagtttttaagaagtcttattacattattgaccaacaataaaatagagaaaatattcggtaaagcctcatt

SEQ ID NO: 419612 - DNA, 311 bp, Homo sapiens
agacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtatatatctacatatttgttccttgttgattgattctgaaaatgtcacattaaacacctagtcaaattttaacaaagaatagattagtttagatgaggatattagtgacttccaagatt

SEQ ID NO: 419613 - DNA, 1417 bp, Homo sapiens
acggcagaggactatccgccagccccgcccccgcctcgccgcaggtcgcgcgcagctggcgcctgaggaactgcggctgcggttccgagcggggtctggggctgttaccattgagtgaccagaaaggctctcggtgcaaagcgttcctgcagaattgcttccacgtaaagggaccttcgggaaatttcgctggataccggctggcattgacaaacccagcgtccctgagccttgtgaggtttccaggcaggctgattgcgaggcaacatgtctgcttcggtgaaagaaagccttcagcttcagctactggagatggaaatgctgttttctatgtttcctaaccaaggagaagtaaaacttgaagatgtaaatgccctgacgaatataaagaggtatttggaaggcacaagggaggcgctgccaccaaaaatcgaatttgtaattacactccagattgaagagcccaaggtgaaaattgatttgcaagtgaccatgcctcacagctacccctatgtagcattgcagctgtttggacggtcatctgaacttgacagacatcagcagctacttctcaacaaaggtctcacttcttacatagggacttttgatccaggtgagctctgtgtatgtgcagcaatccagtggctacaggacaacagtgcatcttatttcctgaacagaaagcttgtatatgaaccatctacacaagcaaagccagtcaagaacacattcctccgaatgtggatctacagtcaccatatatatcagcaggacctaaggaaaaagattttggatgttgggaaaaggttagatgtgactggattttgcatgacaggaaagcctggtataatctgtgtggagggtttcaaagagcactgtgaggagttctggcacacaattaggtaccccaattggaagcacatttcctgtaagcatgctgaaagcgtggagacagaaggaaatggtgaggacctgcgccttttccattcttttgaagagttactccttgaggctcatggtgactatggattaaggaatgactatcacatgaatctgggccaattcttagaatttctcaagaagcacaaaagtgagcatgtttttcagatactatttggtattgaaagcaaaagttcagactcataaaaagcgattaagaggcctatgcctgtaatttcactaagtcagtatttctgttaataagaccaaattaaaaaggctagtggctgtgtagcatcctcagtgcaaaacccagctccagaattttcacctggtaacgaatttcaactgacagtgaaatgaataggcctttaaactttataacattgcaattgtgatgttatctctaggtttttgtgtgaagtcattcaaaaactatttcattgtaaattaataaaaacaatccatttaaaaaaaa

SEQ ID NO: 419614 - DNA, 1494 bp, Homo sapiens
acggcagaggactatccgccagccccgcccccgcctcgccgcaggtcgcgcgcagctggcgcctgaggaactgcggctgcggttccgagcggggtctggggctgttaccattgagtgaccagaaaggctctcggtgcaaagcgttcctgcagaattgcttccacgtaaagggaccttcgggaaatttcgctggataccggctggcattgacaaacccagcgtccctgagccttgtgaggtttccaggcaggctgattgcgaggcaacatgtctgcttcggtgaaagaaagccttcagcttcagctactggagatggaaatgctgttttctatgtttcctaaccaaggagaagtaaaacttgaagatgtaaatgccctgacgaatataaagaggtatttggaaggcacaagggaggcgctgccaccaaaaatcgaatttgtaattacactccagattgaagagcccaagaggagactttctggttctccagactggattctgtcccgctggttacacacttcaatggaaccctccacttttccatggtgaaaattgatttgcaagtgaccatgcctcacagctacccctatgtagcattgcagctgtttggacggtcatctgaacttgacagacatcagcagctacttctcaacaaaggtctcacttcttacatagggacttttgatccaggtgagctctgtgtatgtgcagcaatccagtggctacaggacaacagtgcatcttatttcctgaacagaaagcttgtatatgaaccatctacacaagcaaagccagtcaagaacacattcctccgaatgtggatctacagtcaccatatatatcagcaggacctaaggaaaaagattttggatgttgggaaaaggttagatgtgactggattttgcatgacaggaaagcctggtataatctgtgtggagggtttcaaagagcactgtgaggagttctggcacacaattaggtaccccaattggaagcacatttcctgtaagcatgctgaaagcgtggagacagaaggaaatggtgaggacctgcgccttttccattcttttgaagagttactccttgaggctcatggtgactatggattaaggaatgactatcacatgaatctgggccaattcttagaatttctcaagaagcacaaaagtgagcatgtttttcagatactatttggtattgaaagcaaaagttcagactcataaaaagcgattaagaggcctatgcctgtaatttcactaagtcagtatttctgttaataagaccaaattaaaaaggctagtggctgtgtagcatcctcagtgcaaaacccagctccagaattttcacctggtaacgaatttcaactgacagtgaaatgaataggcctttaaactttataacattgcaattgtgatgttatctctaggtttttgtgtgaagtcattcaaaaactatttcattgtaaattaataaaaacaatccatttaaaaaaaa

SEQ ID NO: 419615 - DNA, 1198 bp, Homo sapiens
acggcagaggactatccgccagccccgcccccgcctcgccgcaggtcgcgcgcagctggcgcctgaggaactgcggctgcggttccgagcggggtctggggctgttaccattgagtgaccagaaagggagaagtaaaacttgaagatgtaaatgccctgacgaatataaagaggtatttggaaggcacaagggaggcgctgccaccaaaaatcgaatttgtaattacactccagattgaagagcccaaggtgaaaattgatttgcaagtgaccatgcctcacagctacccctatgtagcattgcagctgtttggacggtcatctgaacttgacagacatcagcagctacttctcaacaaaggtctcacttcttacatagggacttttgatccaggtgagctctgtgtatgtgcagcaatccagtggctacaggacaacagtgcatcttatttcctgaacagaaagcttgtatatgaaccatctacacaagcaaagccagtcaagaacacattcctccgaatgtggatctacagtcaccatatatatcagcaggacctaaggaaaaagattttggatgttgggaaaaggttagatgtgactggattttgcatgacaggaaagcctggtataatctgtgtggagggtttcaaagagcactgtgaggagttctggcacacaattaggtaccccaattggaagcacatttcctgtaagcatgctgaaagcgtggagacagaaggaaatggtgaggacctgcgccttttccattcttttgaagagttactccttgaggctcatggtgactatggattaaggaatgactatcacatgaatctgggccaattcttagaatttctcaagaagcacaaaagtgagcatgtttttcagatactatttggtattgaaagcaaaagttcagactcataaaaagcgattaagaggcctatgcctgtaatttcactaagtcagtatttctgttaataagaccaaattaaaaaggctagtggctgtgtagcatcctcagtgcaaaacccagctccagaattttcacctggtaacgaatttcaactgacagtgaaatgaataggcctttaaactttataacattgcaattgtgatgttatctctaggtttttgtgtgaagtcattcaaaaactatttcattgtaaattaataaaaacaatccatttaaaaaaaa

SEQ ID NO: 419616 - DNA, 342 bp, Homo sapiens
gagaagtaaaacttgaagatgtaaatgccctgacgaatataaagaggtatttggaaggcacaagggaggcgctgccaccaaaaatcgaatttgtaattacactccagattgaagagcccaaggtaggtaccctgatttaagtgtttgccaggtgcccagtttttaattgaaacatctagaacatgagctttctgtcaaggaaagatagaaatattccaggtgcatatttccttgtttgaaagatacggaatgctctataaattgtcttcagtaaatatctttaattttatgtaaacatatacacctttttaacaaatatacctggagtttttattgacgcta

SEQ ID NO: 419617 - DNA, 921 bp, Homo sapiens
cacttccgcccatccccctccggatccctctgttcgggctcgggtttccgccgagacgacagggactgccaggtcggctagtgtgaggctcgtgggcggagccaagcgccgccatgtccgccgccctgctgcggcggggcctggagctgctggcggcgtccgaggccccccgggaccctccaggtcaggccaagccgagaggggctccggtgaaacggccccggaagacgaaggcaattcaggcccagaaactgcggaactcggccaagggaaaggtgcccaagtcggcactggacgagtaccggaagcgagagtgtcgagaccacctcagagtaaacctgaagtttctgaccaggacgagaagcaccgtggctgagtctgtgagccagcagattttgcgccagaaccggggccgcaaggcctgtgaccggcctgtggccaagaccaagaagaagaaggctgagggcaccgtgttcaccgaggaagacttccagaagttccagcaggaatacttcggcagctaggctccctggagggcacggtgaagaggccttcaagccctgcagcctccgactcctgctggctccaggaaccggccgtgccgcgcggccagcagatggcgatgcaggaccagcctggctcgaggaagccgcggagctgagccgagtggaggctggaatggagctggtgggccggaagtcctggggaggatttacacacagaccggagctggcttccgcaggcctgggcagagcatctgcacctgccggaaaggaacgtatctgttttgtttgcttttgcccaggtggggcctctgggctgtttgctgtggagcaaggctaattcctgagcccttggggacgacagctccaggagtaggaagaagggtgggcttccaagttacaataaatgtgaacccaa

SEQ ID NO: 419618 - DNA, 610 bp, Homo sapiens
  misc_feature (25)..(25): n is a, c, g, or t
  misc_feature (30)..(30): n is a, c, g, or t
  misc_feature (76)..(76): n is a, c, g, or t
ccggctcagaatccgcacgaaaatntgttnagggctaaagggagaactgaaaggtttaccttttctaaagtgtggnctttctaatgtactatttttctggttgcatcttttctacttcagtacacttggtgtactgggttatggctatactgtattggctctgtgaaaacatatttgtgaaaagagtatgtatggcttcttttgaactgttagatgctgaatatctgttcacttttcaatcccaattctgtcccaatcttaccagatgctactggacttgaatggttaataaaactgcacagtgctgttaaaaaaaaaaaaaaaaaaactcgaggaagccgcggagctgagccgagtggaggctggaatggagctggtgggccggaagtcctggggaggatttacacacagaccggagctggcttccgcaggcctgggcagagcatctgcacctgccggaaaggaacgtatctgttttgtttgcttttgcccaggtggggcctctgggctgtttgctgtggagcaaggctaattcctgagcccttggggacgacagctccaggagtaggaagaagggtgggcttccaagttacaataaatgtgaacccaa

SEQ ID NO: 419619 - DNA, 824 bp, Homo sapiens
cacttccgcccatccccctccggatccctctgttcgggctcgggtttccgccgagacgacagggactgccaggtcggctagtgtgaggctcgtgggcggagccaagcgccgccatgtccgccgccctgctgcggcggggcctggagctgctggcggcgtccgaggccccccgggaccctccaggtcaggccaagccgagaggggctccggtgaaacggccccggaagacgaaggcaattcaggcccagaaactgcggaactcggccaagggaaaggtgcccaagtcggcactgggtaagttcgggaaggggctgaaagtgctgcctccggtgctgggacctgcgccccagaggaggtggcgcttgaggcagggcttgaagcgttcgcccggtattgctagacctactgtgtgccaggcgcggagcggggccctggacatacgaaggtgacagaacacgccaccgtcctggtcctcgtggactacggccctagtggggagagaagcatcaaagaatatcaaacccagtgtgtcattgctaagtgcattgaagcctatgaattaaaagactacggtactctgatggggacttaggccaagtcagccttctctgaggaagcgacatttcagccgagagctgaaggatgtataagagtgagctaggtgaaaagtaggagaatattctaggaagaatagtatgtgcaaaggtcctgagtcagaaaggaggttgttgcctttgagaatttgaaaaaataaaggctggtaaaggtgacctagtgaatgaggatcaaagatggagcatttaaacacattcactaacactctg

SEQ ID NO: 419620 - DNA, 1334 bp, Homo sapiens
gcctcccgagtagctgggattacaggtgcccaccaccacacccagctaattttcgttatttttaatacagacggggtttcaccatgttggccacgctgatctcgaactcctgacctcaggtgacctgcctgcctcggcctcccaaagtgctgagattacaggtgtgagccaccgcacccagccattccagctgttttgtgtttttcaaacacatttgacacatttctgcttcagggcctttgcactgggtgttccctctacctagacaaatgctctttccccggatatccacagctctcttcgagtcatttcagtgagaccttctcattccctcctatttgaaattgcaccctccacccctggaattccccttttctgtttcctcttttgtttttctccatgaaatgtttgcgcttctaaaatactgggtcctttgtccttcatctctcactgaagcgaaagctccagagtagctcccttggtgagtagtattcaggacataattgttggaaaatgggggtgggggccaagagcctggggctttcagcaggacctgtgtggagaatgcatttgatggagaagagcccagccgctgtaataacctgggaagggaacgatgaggtctttggcagggccatgggccagggactgagaatggttccagggggagtgaatctgaaatggtgctccctgcctgctacccacagacgagtaccggaagcgagagtgtcgagaccacctcagagtaaacctgaagtttctgaccaggacgagaagcaccgtggctgagtctgtgagccagcagattttgcgccagaaccggggccgcaaggcctgtgaccggcctgtggccaagaccaagaagaagaaggctgagggcaccgtgttcaccgaggaagacttccagaagttccagcaggaatacttcggcagctaggctccctggagggcacggtgaagaggccttcaagccctgcagcctccgactcctgctggctccaggaaccggccgtgccgcgcggccagcagatggcgatgcaggaccagcctggctcgaggaagccgcggagctgagccgagtggaggctggaatggagctggtgggccggaagtcctggggaggatttacacacagaccggagctggcttccgcaggcctgggcagagcatctgcacctgccggaaaggaacgtatctgttttgtttgcttttgcccaggtggggcctctgggctgtttgctgtggagcaaggctaattcctgagcccttggggacgacagctccaggagtaggaagaagggtgggcttccaagttacaataaatgtgaacccaa

SEQ ID NO: 419621 - DNA, 923 bp, Homo sapiens
tgcgcggattctagggaaacaccaatagccacaagactccatgttatcactgtctatgcgagattaagcagggagatttaacagggtgtctcataagacttgaaagcaggggaacgccaaaatagccacagttatttgctgggacaagatggtgggttattttaagaacagcagctgaaataggagggtgggagggttgcccactccaatattaggcaagtgcagtgtgactatggtaaagacagaagaagctagagcagtctagccccaacgaactctcaaaatggaactactggacgagtaccggaagcgagagtgtcgagaccacctcagagtaaacctgaagtttctgaccaggacgagaagcaccgtggctgagtctgtgagccagcagattttgcgccagaaccggggccgcaaggcctgtgaccggcctgtggccaagaccaagaagaagaaggctgagggcaccgtgttcaccgaggaagacttccagaagttccagcaggaatacttcggcagctaggctccctggagggcacggtgaagaggccttcaagccctgcagcctccgactcctgctggctccaggaaccggccgtgccgcgcggccagcagatggcgatgcaggaccagcctggctcgaggaagccgcggagctgagccgagtggaggctggaatggagctggtgggccggaagtcctggggaggatttacacacagaccggagctggcttccgcaggcctgggcagagcatctgcacctgccggaaaggaacgtatctgttttgtttgcttttgcccaggtggggcctctgggctgtttgctgtggagcaaggctaattcctgagcccttggggacgacagctccaggagtaggaagaagggtgggcttccaagttacaataaatgtgaacccaa

SEQ ID NO: 419622 - DNA, 803 bp, Homo sapiens
cacttccgcccatccccctccggatccctctgttcgggctcgggtttccgccgagacgacagggactgccaggtcggctagtgtgaggctcgtgggcggagccaagcgccgccatgtccgccgccctgctgcggcggggcctggagctgctggcggcgtccgaggccccccgggaccctccaggtcaggccaagccgagaggggctccggtgaaacggccccggaagacgaaggcaattcaggcccagaaactgcggaactcggccaagggaaaggtgcccaagtcggcactggacgagtaccggaagcgagagtgtcgagaccacctcagagtaaacctgaagtttctgaccaggacgagaagcaccgtggctgagtctgtgagccagcagattttgcgccagaaccggggccgcaaggcctgtgaccggcctgtggccaagaccaagaagaagaaggctgagggcaccgtgttcaccgaggaagacttccagaagttccagcaggaatacttcggcagctaggctccctggagggcacggtgaagaggccttcaagccctgcagcctccgactcctgctggctccaggaaccggccgtgccgcgcggccagcagatggcgatgcaggaccagcctggctcgaggaagccgcggagctgagccgagtggaggctggaatggagctggtggggcctctgggctgtttgctgtggagcaaggctaattcctgagcccttggggacgacagctccaggagtaggaagaagggtgggcttccaagttacaataaatgtgaacccaa

SEQ ID NO: 419623 - DNA, 1015 bp, Homo sapiens
  misc_feature (985)..(985): n is a, c, g, or t
  misc_feature (988)..(988): n is a, c, g, or t
gcctcccgagtagctgggattacaggtgcccaccaccacacccagctaattttcgttatttttaatacagacggggtttcaccatgttggccacgctgatctcgaactcctgacctcaggtgacctgcctgcctcggcctcccaaagtgctgagattacaggtgtgagccaccgcacccagccattccagctgttttgtgtttttcaaacacatttgacacatttctgcttcagggcctttgcactgggtgttccctctacctagacaaatgctctttccccggatatccacagctctcttcgagtcatttcagtgagaccttctcattccctcctatttgaaattgcaccctccacccctggaattccccttttctgtttcctcttttgtttttctccatgaaatgtttgcgcttctaaaatactgggtcctttgtccttcatctctcactgaagcgaaagctccagagtagctcccttggtgagtagtattcaggacataattgttggaaaatgggggtgggggccaagagcctggggctttcagcaggacctgtgtggagaatgcatttgatggagaagagcccagccgctgtaataacctgggaagggaacgatgaggtctttggcagggccatgggccagggactgagaatggttccagggggagtgaatctgaaatggtgctccctgcctgctacccacagacgagtaccggaagcgagagtgtcgagaccacctcagagtaaacctgaagtttctgaccaggacgagaagcaccgtggctgagtctgtgagccagcagattttgcgccagaaccggggccgcaaggcctgtgaccggcctgtggccaagaccaagaagaagaaggctgagggcaccgtgttcaccgaggaagacttccagaagttccagcaggaatacttcggcagctaggctccctggagggcacggtgacgtgcgttggcccaacacggtgcgtgnccnacacggtgcgtgcccaccggtgcgtgg

SEQ ID NO: 419624 - DNA, 367 bp, Homo sapiens
taatacagacggggtttcaccatgttggccacgctgatctcgaactcctgacctcaggtgacctgcctgcctcggcctcccaaagtgctgagattacaggtgtgagccaccgcacccagccattccagctgttttgtgtttttcaaacacatttgacacatttctgcttcagggcctttgcactgggtgttccctctacctagacaaatgctctttccccggatatccacagctctcttcgagtcatttcagtgagaccttctcattccctcctatttgaaattgcaccctccacccctggaattccccttttctgtttcctcttttgtttttctccatgaaatgtttgcgcttctaaaatactggg

SEQ ID NO: 419625 - DNA, 429 bp, Homo sapiens
ctataggaagggacctgggaggtgagagccgaggctgttcccctagggacccatggcggtctcagccctgagcatagggtgggaggctgggccagccctgccctgcgccgaactcccctgtgacctttgcgggcctcctctgctcttgaaatgatgggccctcggtcccgcaccctcgccagattttgcgccagaaccggggccgcaaggcctgtgaccggcctgtggccaagaccaagaagaagaaggctgagggcaccgtgttcaccgaggaagacttccagaagttccagcaggaatacttcggcagctaggctccctggagggcacggtgaagaggccttcaagccctgcagcctccgactcctgctggctccaggaaccggccgtgccgcgcggccagcagatggcgatgcaggaccagcctgg

SEQ ID NO: 419626 - DNA, 1432 bp, Homo sapiens
cacttccgcccatccccctccggatccctctgttcgggctcgggtttccgccgagacgacagggactgccaggtcggctagtgtgaggctcgtgggcggagccaagcgccgccatgtccgccgccctgctgcggcggggcctggagctgctggcggcgtccgaggccccccgggaccctccaggtcaggccaagccgagaggggctccggtgaaacggccccggaagacgaaggcaattcaggcccagaaactgcggaactcggccaagggaaaggtgcccaagtcggcactggacgagtaccggaagcgagagtgtcgagaccacctcagagtaaacctgaagtttctgaccaggacgagaagcaccgtggctgagtctgtgagccagcagattttgcgccagaaccggggccgcaaggcctgtgaccggcctgtggccaagaccaagaagaagaaggctgagggcaccgtgttcaccgaggaagacttccagaagttccagcaggaatacttcggcagctaggctccctggagggcacggtgaagaggccttcaagccctgcagcctccgactcctgctggctccaggaaccggccgtgccgcgcggccagcagatggcgatgcaggaccagcctggctcgaggaagccgcggagctgagccgagtggaggctggaatggagctggtgggccggaagtcctggggaggatttacacacagaccggagctggcttccgcaggcctgggcagagcatctgcacctgccggaaaggaacgtatctgttttgtttgcttttgcccaggtggggcctctgggctgtttgctgtggagcaaggctaattcctgagcccttggggacgacagctccaggagtaggaagaagggtgggcttccaagttacaataaatgtgaacccaaaaaaaaaaaaaaaaaaagcaaagaaaaacaaaaaaaaaaaaaaaaataaagaagaaaaaaagaagcaaacaaaaaaaaaaaaggggggggggggcaaacaaatcccccgggggggggccaatatgggcccccctttttttgaaaaggggggccccccatggggggccatataaaccgaaacgcgcggggcgcggccgggtgttcacaacaacgcggcggcgcgacaggagcagaaaaaccggtaggctctagcgggagcgcaaccgctggggacagaccacgaccaccccatccgccgcgggcgggcgcagcgaaccaaaaaggggcgggaaacaccacacccaacccacgagggacatgcacaccagcccgctcccgcagaagcaccaaacacacacccacgacaacggacgacagagcggctgccacaccaacacaccgcgaaacaatcgccggcccgcacacaaaacaacaccgcccccaccgcggacgccctcgcgcacaacatcaa

SEQ ID NO: 419627 - DNA, 966 bp, Homo sapiens
cacttccgcccatccccctccggatccctctgttcgggctcgggtttccgccgagacgacagggactgccaggtcggctagtgtgaggctcgtgggcggagccaagcgccgccatgtccgccgccctgctgcggcggggcctggagctgctggcggcgtccgagggtgaggagggctggccaggggacgtccggcgcgggcaggaggatggtagtggctgcgggcgggagccctggatggaaaacaatccaggccgggcttagccccagtggcatgggaacgctgcgcgccctctgacctgggtctcttcctctctcttcccctacagccccccgggaccctccaggtcaggccaagccgagaggggctccggtgaaacggccccggaagacgaaggcaattcaggcccagaaactgcggaactcggccaagggaaaggtgcccaagtcggcactggacgagtaccggaagcgagagtgtcgagaccacctcagagtaaacctgaagtttctgaccaggacgagaagcaccgtggctgagtctgtgagccagcagattttgcgccagaaccggggccgcaaggcctgtgaccggcctgtggccaagaccaagaagaagaaggctgagggcaccgtgttcaccgaggaagacttccagaagttccagcaggaatacttcggcagctaggctccctggagggcacggtgaagaggccttcaagccctgcagcctccgactcctgctggctccaggaaccggccgtgccgcgcggccagcagatggcgatgcaggaccagcctggctcgaggaagccgcggagctgagccgagtggaggctggaatggagctggtggggcctctgggctgtttgctgtggagcaaggctaattcctgagcccttggggacgacagctccaggagtaggaagaagggtgggcttccaagttacaataaatgtgaacccaa

SEQ ID NO: 419628 - DNA, 981 bp, Homo sapiens
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagtgattctaccagaaaggaatgaagaacagaaccttcaggaattgagtcacaatgcagacaaatatcaaatgggagattgttgcaaggaagagattgatgatagtattttctactagccattgggaagataaaaggagacagaagattgaagcctttgccagccattctttccctttttgcttccaaactcctcaactgggaaccttcatatgtgcagtatttatattggatcatactggtgattataaaagttcctaggaggctagaagagccaaccaacagagaagggaaagcagtctgttctgaacatagggacataagttcattcatgccaagtatctttccagcatgtttctcccatttagaatatctagcatgtaaggcctttcaatattaatataagcccaatatcagctctttctctttgtatttcatctctttctactctcctatttgtattttgtgttcctatcaaagtgtcgtatctgggagatgacctgccttatcctgttctataacagttttgtttgctgctgtgtctttagaacagtgcctggcacacagtaagcactcaataaatctttgatgaatgaa

SEQ ID NO: 419629 - DNA, 1034 bp, Homo sapiens
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactgtgattctaccagaaaggaatgaagaacagaaccttcaggaattgagtcacaatgcagacaaatatcaaatgggagattgttgcaaggaagagattgatgatagtattttctactagccattgggaagataaaaggagacagaagattgaagcctttgccagccattctttccctttttgcttccaaactcctcaactgggaaccttcatatgtgcagtatttatattggatcatactggtgattataaaagttcctaggaggctagaagagccaaccaacagagaagggaaagcagtctgttctgaacatagggacataagttcattcatgccaagtatctttccagcatgtttctcccatttagaatatctagcatgtaaggcctttcaatattaatataagcccaatatcagctctttctctttgtatttcatctctttctactctcctatttgtattttgtgttcctatcaaagtgtcgtatctgggagatgacctgccttatcctgttctataacagttttgtttgctgctgtgtctttagaacagtgcctggcacacagtaagcactcaataaatctttgatgaatgaa

SEQ ID NO: 419630 - DNA, 670 bp, Homo sapiens
  misc_feature (40)..(40): n is a, c, g, or t
cccacgaccaatacgcctgatcacccccgacgccccaagnagtgagggctgtagcttctcaccacacaggatttagtgattctaccagaaaggaatgaagaacagaaccttcaggaattgagtcacaatgcagacaaatatcaaatgggagattgttgcaaggaagagattgatgatagtattttctactagccattgggaagataaaaggagacagaagattgaagcctttgccagccattctttccctttttgcttccaaactcctcaactgggaaccttcatatgtgcagtatttatattggatcatactggtgattataaaagttcctaggaggctagaagagccaaccaacagagaagggaaagcagtctgttctgaacatagggacataagttcattcatgccaagtatctttccagcatgtttctcccatttagaatatctagcatgtaaggcctttcaatattaatataagcccaatatcagctctttctctttgtatttcatctctttctactctcctatttgtattttgtgttcctatcaaagtgtcgtatctgggagatgacctgccttatcctgttctataacagttttgtttgctgctgtgtctttagaacagtgcctggcacacagtaagcactcaataaatctttgatgaatgaa

SEQ ID NO: 419631 - DNA, 656 bp, Homo sapiens
ggatgaagtagggcgcgacaaccaacgttttagcataactggcccgtttcgcgcatctaccatgattctaccagaaaggaatgaagaacagaaccttcaggaattgagtcacaatgcagacaaatatcaaatgggagattgttgcaaggaagagattgatgatagtattttctactagccattgggaagataaaaggagacagaagattgaagcctttgccagccattctttccctttttgcttccaaactcctcaactgggaaccttcatatgtgcagtatttatattggatcatactggtgattataaaagttcctaggaggctagaagagccaaccaacagagaagggaaagcagtctgttctgaacatagggacataagttcattcatgccaagtatctttccagcatgtttctcccatttagaatatctagcatgtaaggcctttcaatattaatataagcccaatatcagctctttctctttgtatttcatctctttctactctcctatttgtattttgtgttcctatcaaagtgtcgtatctgggagatgacctgccttatcctgttctataacagttttgtttgctgctgtgtctttagaacagtgcctggcacacagtaagcactcaataaatctttgatgaatgaa

SEQ ID NO: 419632 - DNA, 2544 bp, Homo sapiens
  misc_feature (2510)..(2510): n is a, c, g, or t
  misc_feature (2519)..(2519): n is a, c, g, or t
  misc_feature (2528)..(2528): n is a, c, g, or t
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagattcagctggctaccccacttggctacagagtactaaagaagagactgaacttgatcctgctgcccttgcatacacaacactcccattgacgctagtgaagacttaagcgcatgaaaggattccaggatcaaaaggttagctctatggggagctgtgtctgggcaatccatttttttctattgacagtgaaaacgttttatagttctttttcaaagttttcccaaacttttacaataacaggcaacttgtgaaaaagtgagaaggcatctaattgaactatatccagaggagatcatggcagagaccaacaggaagaaaaacatttccaaaccacagcgatattggtcaaatcaattgtatttgaagaataaagcatttgaggcgtcggctgagaaaaattttcattatgaaacttggttggactatgaagcagaatgtgagataaaataaaacacagagctcatgagtttttatctttgtctgctaatgacttatgctagcaggattatactttttttttgcattttatgagatgtatgaactaggaagaaaatacatgctatatctaaatggattagacgtgcagattcttaactaacatttaattcattgctagtaaaacaaatgccttaaaacatttaaaaaagtgaaattatcttaaggagataattaacaagcagagtagaatagcatttttgaagaaagtgtaatatggttctacactggcattttctgcatttattgaagatacttagtctatccaacaattcactcattcattctttcatgaaaccctgtctctactaaaaatacaaaaaaaaattagctgggcacgggggtaggcccttgtagtcccagctactcgggaggctgaggcaggagaatggcgtgaacccgggaggcagagcttgtagtgaaccaagatcgcgtcactgcactccagcctaggtgacagagcgagactccgtctcaaaacaacaacaacaacaacaacaacaacaacaacaacaacaaatttctttgtgcacttactatatgcccaatgctaatctaatagttttacaagacctcaattgaacaagtgtctgaggaaatggattgcatctaataaagcaagacacaccaactgtggatgggtggtgtgtctagagtattttgcattcctaaatcactcttctggagaaaatttgtatcaataattttgtctagcttcacctggagttacacattttgattggtaagtggttgctctggctatatcaaataaaagtgtcaagagtgagcatccttgccttgtgctgaatcacaaaggaatacctttcagtttttctccattgattatgatagcagtgggcttttcacagtgggctttactgtgttgaggtaccctaatgacaagttcaccccagtgttttctgaggagtctacctggaaatgagaaccatctgtccttcctatagtagttcttctcagaatgccgactctatgctaatggaggaggtctgatggccgggaggacaggaagaaggaacccacaatgaagcaaaagttgcgtttaactctgtcctcaccattcctctcctggacctgtcctaaactggaagctgggggaggatggagtgctggaatgctgcagaagtctcatgggagggcgcctggtgttcaccacatgtgtacactgttgcacgaccagatggaaatttgaatgctggggctcagtggaacacctgaaggaagctggtgaggcagatgtcccgctatgccttccaagtgtcatgcaaccagttcatgcctgtcagcatctctgccggtggactctgtgagtcagcaaatctacagagcagagagccacaagtggggacagatgtggtcaaatgccatttaaatcagtgattctcaacccaggagttgtcatggcactggccttgagtgagctggaccaagggaagtggtagaattccccatgaaggaccaagtgagcagatagaagtttctccattttaactttttctgagtcaatttaaaaaacacctagtgcctttttctgtacatagtgcctgtgggtttaatttaagcctacccaaatgtgcttttatcccacctattttgaaccttgcatgtntccgggatnagaattaanataagctataaatatt

SEQ ID NO: 419633 - DNA, 1563 bp, Homo sapiens
  misc_feature (1529)..(1529): n is a, c, g, or t
  misc_feature (1538)..(1538): n is a, c, g, or t
  misc_feature (1547)..(1547): n is a, c, g, or t
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactggtattctccactggttgaatgcaaatggaagccagaggaaaagggaacccttgacacagttttcatatagattggcctccagggcagacagcaggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggaggaggtctgatggccgggaggacaggaagaaggaacccacaatgaagcaaaagttgcgtttaactctgtcctcaccattcctctcctggacctgtcctaaactggaagctgggggaggatggagtgctggaatgctgcagaagtctcatgggagggcgcctggtgttcaccacatgtgtacactgttgcacgaccaggttggcactttgcatgtgggaaacgatcagagaatggtgggggatgcttaagaggcatcactggaatcctacggtaccacagaccagagccttcccttcccttcctctcccacagatggaaatttgaatgctggggctcagtggaacacctgaaggaagctggtgaggcagatgtcccgctatgccttccaagtgtcatgcaaccagttcatgcctgtcagcatctctgccggtggactctgtgagtcagcaaatctacagagcagagagccacaagtggggacagatgtggtcaaatgccatttaaatcagtgattctcaacccaggagttgtcatggcactggccttgagtgagctggaccaagggaagtggtagaattccccatgaaggaccaagtgagcagatagaagtttctccattttaactttttctgagtcaatttaaaaaacacctagtgcctttttctgtacatagtgcctgtgggtttaatttaagcctacccaaatgtgcttttatcccacctattttgaaccttgcatgtntccgggatnagaattaanataagctataaatatt

SEQ ID NO: 419634 - DNA, 1559 bp, Homo sapiens
  misc_feature (1525)..(1525): n is a, c, g, or t
  misc_feature (1534)..(1534): n is a, c, g, or t
  misc_feature (1543)..(1543): n is a, c, g, or t
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactggtattctccactggttgaatgcaaatggaagccagaggaaaagggaacccttgacacagttttcatatagattggcctccagggcagacagcaggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggtaccctaatgacaagttcaccccagtgttttctgaggagtctacctggaaatgagaaccatctgtccttcctatagtagttcttctcagaatgccgactctatgctaatggaggaggtctgatggccgggaggacaggaagaaggaacccacaatgaagcaaaagttgcgtttaactctgtcctcaccattcctctcctggacctgtcctaaactggaagctgggggaggatggagtgctggaatgctgcagaagtctcatgggagggcgcctggtgttcaccacatgtgtacactgttgcacgaccagatggaaatttgaatgctggggctcagtggaacacctgaaggaagctggtgaggcagatgtcccgctatgccttccaagtgtcatgcaaccagttcatgcctgtcagcatctctgccggtggactctgtgagtcagcaaatctacagagcagagagccacaagtggggacagatgtggtcaaatgccatttaaatcagtgattctcaacccaggagttgtcatggcactggccttgagtgagctggaccaagggaagtggtagaattccccatgaaggaccaagtgagcagatagaagtttctccattttaactttttctgagtcaatttaaaaaacacctagtgcctttttctgtacatagtgcctgtgggtttaatttaagcctacccaaatgtgcttttatcccacctattttgaaccttgcatgtntccgggatnagaattaanataagctataaatatt

SEQ ID NO: 419635 - DNA, 1448 bp, Homo sapiens
  misc_feature (1414)..(1414): n is a, c, g, or t
  misc_feature (1423)..(1423): n is a, c, g, or t
  misc_feature (1432)..(1432): n is a, c, g, or t
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactggtattctccactggttgaatgcaaatggaagccagaggaaaagggaacccttgacacagttttcatatagattggcctccagggcagacagcaggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggaggaggtctgatggccgggaggacaggaagaaggaacccacaatgaagcaaaagttgcgtttaactctgtcctcaccattcctctcctggacctgtcctaaactggaagctgggggaggatggagtgctggaatgctgcagaagtctcatgggagggcgcctggtgttcaccacatgtgtacactgttgcacgaccagatggaaatttgaatgctggggctcagtggaacacctgaaggaagctggtgaggcagatgtcccgctatgccttccaagtgtcatgcaaccagttcatgcctgtcagcatctctgccggtggactctgtgagtcagcaaatctacagagcagagagccacaagtggggacagatgtggtcaaatgccatttaaatcagtgattctcaacccaggagttgtcatggcactggccttgagtgagctggaccaagggaagtggtagaattccccatgaaggaccaagtgagcagatagaagtttctccattttaactttttctgagtcaatttaaaaaacacctagtgcctttttctgtacatagtgcctgtgggtttaatttaagcctacccaaatgtgcttttatcccacctattttgaaccttgcatgtntccgggatnagaattaanataagctataaatatt

SEQ ID NO: 419636 - DNA, 1249 bp, Homo sapiens
  misc_feature (1215)..(1215): n is a, c, g, or t
  misc_feature (1224)..(1224): n is a, c, g, or t
  misc_feature (1233)..(1233): n is a, c, g, or t
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactggtattctccactggttgaatgcaaatggaagccagaggaaaagggaacccttgacacagttttcatatagattggcctccagggcagacagcaggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgagatggaaatttgaatgctggggctcagtggaacacctgaaggaagctggtgaggcagatgtcccgctatgccttccaagtgtcatgcaaccagttcatgcctgtcagcatctctgccggtggactctgtgagtcagcaaatctacagagcagagagccacaagtggggacagatgtggtcaaatgccatttaaatcagtgattctcaacccaggagttgtcatggcactggccttgagtgagctggaccaagggaagtggtagaattccccatgaaggaccaagtgagcagatagaagtttctccattttaactttttctgagtcaatttaaaaaacacctagtgcctttttctgtacatagtgcctgtgggtttaatttaagcctacccaaatgtgcttttatcccacctattttgaaccttgcatgtntccgggatnagaattaanataagctataaatatt

SEQ ID NO: 419637 - DNA, 1266 bp, Homo sapiens
  misc_feature (1232)..(1232): n is a, c, g, or t
  misc_feature (1241)..(1241): n is a, c, g, or t
  misc_feature (1250)..(1250): n is a, c, g, or t
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggtaccctaatgacaagttcaccccagtgttttctgaggagtctacctggaaatgagaaccatctgtccttcctatagtagttcttctcagaatgccgactctatgctaatgatggaaatttgaatgctggggctcagtggaacacctgaaggaagctggtgaggcagatgtcccgctatgccttccaagtgtcatgcaaccagttcatgcctgtcagcatctctgccggtggactctgtgagtcagcaaatctacagagcagagagccacaagtggggacagatgtggtcaaatgccatttaaatcagtgattctcaacccaggagttgtcatggcactggccttgagtgagctggaccaagggaagtggtagaattccccatgaaggaccaagtgagcagatagaagtttctccattttaactttttctgagtcaatttaaaaaacacctagtgcctttttctgtacatagtgcctgtgggtttaatttaagcctacccaaatgtgcttttatcccacctattttgaaccttgcatgtntccgggatnagaattaanataagctataaatatt

SEQ ID NO: 419638 - DNA, 615 bp, Homo sapiens
  misc_feature (445)..(445): n is a, c, g, or t
  misc_feature (534)..(534): n is a, c, g, or t
  misc_feature (615)..(615): n is a, c, g, or t
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactgtgggncgactctggaaccgagctgcctgggtgaatcccagctccactacttactagctgtgccttgttgggtaaattatctgttggaccttttntaaaacaagtactattaatacctcattggactgttgtaaggatgtaaatgagctaacatattaaaggaatttcaacagtgn

SEQ ID NO: 419639 - DNA, 908 bp, Homo sapiens
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccaggtattctccactggttgaatgcaaatggaagccagaggaaaagggaacccttgacacagttttcatatagattggcctccagggcagacagcaggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggtaagttccttctgtacctattttgttgagttttcattacgaatgatgttgatttggtcaaatgctttttctgcatctgttgaaatggtcatgtggtttttatctttcattctgttaatatgatgtaacaccttgattgatttgcatatattaaaccagccttgcatcccaggaa

SEQ ID NO: 419640 - DNA, 452 bp, Homo sapiens
agcacaggtggcacagaagtggatgaatccacatctgtcagattcagcagccctggagttctctaccacgctgtacgattcaacctgagcccacacaggaggcgtggtctccttcttcaacggtgtgtgtgtgtgtgcgcgcgcgcctgcctagagttaatgattaagtttgctgaagcccttcttcccggtcctaagctgcctgttgcgaaggcgctttcattgaattcagtttctcttaccgtcttaacttgttcataaactttttgagataggaatgggcagtttttctgtgtcacttaggatgattttttttttaatggcgtgataagtgaactgaatccagcaaagacgagtttctgttgtgcaacacgttggtatactgacagctaccacgtattgactgtgtactgtgtgctgggcactgtgctaaataaatgatttacgaatta

SEQ ID NO: 419641 - DNA, 763 bp, Homo sapiens
agcacaggtggcacagaagtggatgaatccacatctgtcagattcagcagccctggagttctctaccacgctgtacgattcaacctgagcccacacaggaggcgtggtctccttcttcaacggtgtgtgtgtgtgtgcgcgcgcgcctgcctagagttaatgattaagtttgctgaagcccttcttcccggtcctaagctgcctgttgcgaaggcgctttcattgaattcagtttctcttaccgtcttaacttgttcataaactttttgagataggaatgggcagtttttctgtgtcacttaggatgattttttttttaatggcgtgataagtgaactgaatccagcaaagacgagtttctgttgtgcaacacgttggtatactgacagctaccacgtattgactgtgtactgtgtgctgggcactgtgctaaataaatgatttacgaattaatcgtgtttattgctcacaacagccttatgaagtaggtattatcttcactttacagatgaggacacctgaggttcagattaagaaatctgccccaaagtcttagaactggtaagtagaagcaccatatctaggcaaacctgtctaccttcaaaaaaaatgggcactctgataggacaattaacgataataaagttgtaatttttttttttttttttgagataggaatgggcagtttttctgtgtcacttaggatgatttttttttttaatggcgtgataagtgaactgaatccagcaaagacgagtttctg

SEQ ID NO: 419642 - DNA, 2654 bp, Homo sapiens
  misc_feature (55)..(55): n is a, c, g, or t
  misc_feature (2191)..(2192): n is a, c, g, or t
  misc_feature (2231)..(2231): n is a, c, g, or t
  misc_feature (2253)..(2253): n is a, c, g, or t
cagcatcatgtaagatgtgcctgctcccccttccgccatgattgtaagtttcccnaggcctcctcagccatgtggaactatgagaaaactgaagataagaaaaattctgcagcttgcctagaatatggctgctagcaaatgttgtaaaggaactcagatctgcccattcccagagcctgaggtcttaatctattctgctgacttaaattctgtatcatgagtttcacaacctgaagcttgggaactcctgtggagccctggagtgatgtttaaggaatacttcagtgagctgtacacactacaactcccatattgcattttagtttttaaaaatagtttctttaaaataaatgcaagaggggtctctgaacaatatgctcaggtctccaaactggctgaatttaccacggactatttttctagcatttggattttaacagaagcagagcaaagttgggatgaccacacccttcctgggcttcaaggactttaaaaatgtcctggctgccccagaagttggagagctctacatttcagcgttggtggtattctccactggttgaatgcaaatggaagccagaggaaaagggaacccttgacacagttttcatatagattggcctccagggcagacagcagattccaagaaccaggaggttgtttgctgtactctcccttgtacagttagctgtctctagtgcctgaatgcactaattgtcctttgggtatggatgaggtaatgaaggaaagggatgctgggaagagaggccacatgagaaggctgcagcaaactaagtgttgcttgctaaagaaaaatgaaagctggaatttcagcagggaagaaagtatatgccccaccgtgatgagtacaaacacacagcatcagggaagccacacagaatgaagctctgagaagactgttagcattttccctccacgccccaggggaaaaggttggttctctaacttgatgtatacaaattttctgagaagattatttaaaaagtagtttccacccaatccaaggattccgattcagcagggctgaggtactccgaagcagggtatggattctgctttcatcttccaatgcaagcctgtttccacagggttgagatctggcatggacaatttcagcctgaaacgattacttttggaaatttgcagatattgttaacttcttagtcctttgaagaaaaatcaaattttttcttaagaagagacttttgaaactcacaatatgaattcaagaagcaaaaaagaaaatcgaatttcacaaatgggataccaatagcttggaaaaatccattgcttttgcagggtttgttattgagggaaccctgcctttcccagcatccttaacatttcttcctcaaataaaagaggcacattgatttgaatagttaaagatttgtctcatttccttgccaaggaggattatgtttccagctttttgttaattctgggcatttcaaccactgcttctgataacatcctgctttactgtgctaggcattccttggacccaggactggggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggtaccctaatgacaagttcaccccagtgttttctgaggagtctacctggaaatgagaaccatctgtccttcctatagtagttcttctcagaatgccgactctatgctaatggtgtagttattattcaatttataatttggcatcctaccatatatataatttaacatctactcttttaaccagcttaggacttgtcaacccactgcttgttctgtgttccacactggtattcaaagatgtgaaagcaagaagaaggctaggatgagcaacacaacagaataactcaagcaacagagcaattctgaaacacaaggaaaaaggacttactcatacttccctcatggattatctgagaattgaatgaaaacaatcagtaatgtattcaattcataacaaatgtcannagtgaaaagaacagagaactgacaaaagctaaaactacncaaagtgagatttgctcatgcnttatgtaaacaggaaaaaataaaatcctgggaatttgtatgggtaactgcactggctattgagagatcaaatgatatgcaccttcaggaactcttccagcaagagctactcagtgaggagacattcatcattagcacattcagaaattatagctctgatatgttttctgggtggccggatgcaaaggatcatccatagttatgaaaactcaagaacagggaagtcaattagtatatttataaatctgtattcctctcctgtcaaggaatctccctgtatatgaatgatagctgtgtccttgatttgagtaactctttttcctaatcaaaagaaactcaaatgaacaggcccatatgtcttatcagaacaaactatcctgtaataaaatggaaagaggtttt

SEQ ID NO: 419643 - DNA, 2234 bp, Homo sapiens
  misc_feature (55)..(55): n is a, c, g, or t
  misc_feature (2200)..(2200): n is a, c, g, or t
  misc_feature (2209)..(2209): n is a, c, g, or t
  misc_feature (2218)..(2218): n is a, c, g, or t
cagcatcatgtaagatgtgcctgctcccccttccgccatgattgtaagtttcccnaggcctcctcagccatgtggaactatgagaaaactgaagataagaaaaattctgcagcttgcctagaatatggctgctagcaaatgttgtaaaggaactcagatctgcccattcccagagcctgaggtcttaatctattctgctgacttaaattctgtatcatgagtttcacaacctgaagcttgggaactcctgtggagccctggagtgatgtttaaggaatacttcagtgagctgtacacactacaactcccatattgcattttagtttttaaaaatagtttctttaaaataaatgcaagaggggtctctgaacaatatgctcaggtctccaaactggctgaatttaccacggactatttttctagcatttggattttaacagaagcagagcaaagttgggatgaccacacccttcctgggcttcaaggactttaaaaatgtcctggctgccccagaagttggagagctctacatttcagcgttggtggtattctccactggttgaatgcaaatggaagccagaggaaaagggaacccttgacacagttttcatatagattggcctccagggcagacagcagattccaagaaccaggaggttgtttgctgtactctcccttgtacagttagctgtctctagtgcctgaatgcactaattgtcctttgggtatggatgaggtaatgaaggaaagggatgctgggaagagaggccacatgagaaggctgcagcaaactaagtgttgcttgctaaagaaaaatgaaagctggaatttcagcagggaagaaagtatatgccccaccgtgatgagtacaaacacacagcatcagggaagccacacagaatgaagctctgagaagactgttagcattttccctccacgccccaggggaaaaggttggttctctaacttgatgtatacaaattttctgagaagattatttaaaaagtagtttccacccaatccaaggattccgattcagcagggctgaggtactccgaagcagggtatggattctgctttcatcttccaatgcaagcctgtttccacagggttgagatctggcatggacaatttcagcctgaaacgattacttttggaaatttgcagtgagtggaaacagtcatgtagagctgtggatcttgctacctggatcaataacttcttctagttaagcttcttgccaaggaaaagcaaggaatatcaaatttcatagacctaatgaaccactggaaactgcttgcacccatgtgtgcaaggatcgctttttatgatttatacaaaccaaagcactcattggaataagaataatagctaacgtttatttatcatttattatcctggccactgtgccaagtatttatatacagtgagttatttaatccctgcaacaacccatgggagtggggtttaatctggactgaattggaggaaaggaactggcaccagagtggaggctggaaggatggtggaactgacactgggacagaacacagaaaacagaatctaatgctagaggaggtctgatggccgggaggacaggaagaaggaacccacaatgaagcaaaagttgcgtttaactctgtcctcaccattcctctcctggacctgtcctaaactggaagctgggggaggatggagtgctggaatgctgcagaagtctcatgggagggcgcctggtgttcaccacatgtgtacactgttgcacgaccagatggaaatttgaatgctggggctcagtggaacacctgaaggaagctggtgaggcagatgtcccgctatgccttccaagtgtcatgcaaccagttcatgcctgtcagcatctctgccggtggactctgtgagtcagcaaatctacagagcagagagccacaagtggggacagatgtggtcaaatgccatttaaatcagtgattctcaacccaggagttgtcatggcactggccttgagtgagctggaccaagggaagtggtagaattccccatgaaggaccaagtgagcagatagaagtttctccattttaactttttctgagtcaatttaaaaaacacctagtgcctttttctgtacatagtgcctgtgggtttaatttaagcctacccaaatgtgcttttatcccacctattttgaaccttgcatgtntccgggatnagaattaanataagctataaatatt

SEQ ID NO: 419644 - DNA, 2549 bp, Homo sapiens
  misc_feature (2086)..(2087): n is a, c, g, or t
  misc_feature (2126)..(2126): n is a, c, g, or t
  misc_feature (2148)..(2148): n is a, c, g, or t
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactggtattctccactggttgaatgcaaatggaagccagaggaaaagggaacccttgacacagttttcatatagattggcctccagggcagacagcagattccaagaaccaggaggttgtttgctgtactctcccttgtacagttagctgtctctagtgcctgaatgcactaattgtcctttgggtatggatgaggtaatgaaggaaagggatgctgggaagagaggccacatgagaaggctgcagcaaactaagtgttgcttgctaaagaaaaatgaaagctggaatttcagcagggaagaaagtatatgccccaccgtgatgagtacaaacacacagcatcagggaagccacacagaatgaagctctgagaagactgttagcattttccctccacgccccaggggaaaaggttggttctctaacttgatgtatacaaattttctgagaagattatttaaaaagtagtttccacccaatccaaggattccgattcagcagggctgaggtactccgaagcagggtatggattctgctttcatcttccaatgcaagcctgtttccacagggttgagatctggcatggacaatttcagcctgaaacgattacttttggaaatttgcagatattgttaacttcttagtcctttgaagaaaaatcaaattttttcttaagaagagacttttgaaactcacaatatgaattcaagaagcaaaaaagaaaatcgaatttcacaaatgggataccaatagcttggaaaaatccattgcttttgcagggtttgttattgagggaaccctgcctttcccagcatccttaacatttcttcctcaaataaaagaggcacattgatttgaatagttaaagatttgtctcatttccttgccaaggaggattatgtttccagctttttgttaattctgggcatttcaaccactgcttctgataacatcctgctttactgtgctaggcattccttggacccaggactggggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggtaccctaatgacaagttcaccccagtgttttctgaggagtctacctggaaatgagaaccatctgtccttcctatagtagttcttctcagaatgccgactctatgctaatggtgtagttattattcaatttataatttggcatcctaccatatatataatttaacatctactcttttaaccagcttaggacttgtcaacccactgcttgttctgtgttccacactggtattcaaagatgtgaaagcaagaagaaggctaggatgagcaacacaacagaataactcaagcaacagagcaattctgaaacacaaggaaaaaggacttactcatacttccctcatggattatctgagaattgaatgaaaacaatcagtaatgtattcaattcataacaaatgtcannagtgaaaagaacagagaactgacaaaagctaaaactacncaaagtgagatttgctcatgcnttatgtaaacaggaaaaaataaaatcctgggaatttgtatgggtaactgcactggctattgagagatcaaatgatatgcaccttcaggaactcttccagcaagagctactcagtgaggagacattcatcattagcacattcagaaattatagctctgatatgttttctgggtggccggatgcaaaggatcatccatagttatgaaaactcaagaacagggaagtcaattagtatatttataaatctgtattcctctcctgtcaaggaatctccctgtatatgaatgatagctgtgtccttgatttgagtaactctttttcctaatcaaaagaaactcaaatgaacaggcccatatgtcttatcagaacaaactatcctgtaataaaatggaaagaggtttt

SEQ ID NO: 419645 - DNA, 2968 bp, Homo sapiens
  misc_feature (55)..(55): n is a, c, g, or t
cagcatcatgtaagatgtgcctgctcccccttccgccatgattgtaagtttcccnaggcctcctcagccatgtggaactatgagaaaactgaagataagaaaaattctgcagcttgcctagaatatggctgctagcaaatgttgtaaaggaactcagatctgcccattcccagagcctgaggtcttaatctattctgctgacttaaattctgtatcatgagtttcacaacctgaagcttgggaactcctgtggagccctggagtgatgtttaaggaatacttcagtgagctgtacacactacaactcccatattgcattttagtttttaaaaatagtttctttaaaataaatgcaagaggggtctctgaacaatatgctcaggtctccaaactggctgaatttaccacggactatttttctagcatttggattttaacagaagcagagcaaagttgggatgaccacacccttcctgggcttcaaggactttaaaaatgtcctggctgccccagaagttggagagctctacatttcagcgttggtggtattctccactggttgaatgcaaatggaagccagaggaaaagggaacccttgacacagttttcatatagattggcctccagggcagacagcagattccaagaaccaggaggttgtttgctgtactctcccttgtacagttagctgtctctagtgcctgaatgcactaattgtcctttgggtatggatgaggtaatgaaggaaagggatgctgggaagagaggccacatgagaagtggttctctaacttgatgtatacaaattttctgagaagattatttaaaaagtagtttccacccaatccaaggattccgattcagcagggctgaggtactccgaagcagggtatggattctgctttcatcttccaatgcaagcctgtttccacagggttgagatctggcatggacaatttcagcctgaaacgattacttttggaaatttgcagtgagtggaaacagtcatgtagagctgtggatcttgctacctggatcaataacttcttctagttaagcttcttgccaaggaaaagcaaggaatatcaaatttcatagacctaatgaaccactggaaactgcttgcacccatgtgtgcaaggatcgctttttatgatttatacaaaccaaagcactcattggaataagaataatagctaacgtttatttatcatttattatcctggccactgtgccaagtatttatatacagtgagttatttaatccctgcaacaacccatgggtaggtactattatttttccttctttatagataagaacattgaggcacaaaaatgctaaattacagagtgggatcaatgtgttgctcgcttagaaaatgagtcaagttccatatgtgtgagtaaatgtgaacattcccacttccttgtcacttggttttctttctcaagtttggtgtgtttgctctgtgttcacaggatattgttaacttcttagtcctttgaagaaaaatcaaattttttcttaagaagagacttttgaaactcacaatatgaattcaagaagcaaaaaagaaaatcgaatttcacaaatgggataccaatagcttggaaaaatccattgcttttgcagggtttgttattgagggaaccctgcctttcccagcatccttaacatttcttcctcaaataaaagaggcacattgatttgaatagttaaagatttgtctcatttccttgccaaggaggattatgtttccagctttttgttaattctgggcatttcaaccactgcttctgataacatcctgctttactgtgctaggcattccttggacccaggactggggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggaggaggtctgatggccgggaggacaggaagaaggaacccacaatgaagcaaaagttgcgtttaactctgtcctcaccattcctctcctggacctgtcctaaactggaagctgggggaggatggagtgctggaatgctgcagaagtctcatgggagggcgcctggtgttcaccacatgtgtacactgttgcacgaccaggaaccttcagaaagggcagaaaggaagtttacttctgcctctacaatggatttgcctactttagacatgttttcaagatttatccacgtcatggcatataccagaacttcatttcttttatgattgaataatattacatggttttaatatactatattttgtttatctgttcatcaattaataaatctttgggttgttttcacttttaggctataataattaacgctgttaggaatatttacttgtaagtttttgttatatgtttttaattctcctgggtagatacttagggataaaattgctgaattagattgtaactttatgtttagaaactgcccaactgttttccaaagtaactatcattttaatatttcaccagcattgtatgacagttctggtctttccttatttaaactaatacttaattattgccttttattgtagctatcctagtagatatgaagtgttatctcattatggttttgatttgcattctctaatgactaataatatcaagcatcttttcatgtgtatacaagatatttgtatatcttctttagagaaatgtctactcaaatcctgtgcctatgttttaattggataatttatgtttttattgttgagttgtaatagtttttaaatatattctggatcctagacctttaaca

SEQ ID NO: 419646 - DNA, 2457 bp, Homo sapiens
  misc_feature (269)..(269): n is a, c, g, or t
  misc_feature (1994)..(1995): n is a, c, g, or t
  misc_feature (2034)..(2034): n is a, c, g, or t
  misc_feature (2056)..(2056): n is a, c, g, or t
cttccaaaccaacatgtgtgaaacataatggagtctcactctgttacccagactggagtgcagtggcatgatctcggctctacaacctccgcctcccaggttcagattatttggaaatttccagctttgtgcactagacagaagacctttgacctctgggatgacagcataaaggcgagggtagatttctaaagaaaaggatctgtgaacatttaggaaagcaagcagtggtcaccaggaatttgtgtggattgctgataaagaagtcnttctgcactaacttcatctcttctttggcattatggctcatctgataaataaatgcaatagacatatctttggatttcagtattctccactggttgaatgcaaatggaagccagaggaaaagggaacccttgacacagttttcatatagattggcctccagggcagacagcagattccaagaaccaggaggttgtttgctgtactctcccttgtacagttagctgtctctagtgcctgaatgcactaattgtcctttgggtatggatgaggtaatgaaggaaagggatgctgggaagagaggccacatgagaaggctgcagcaaactaagtgttgcttgctaaagaaaaatgaaagctggaatttcagcagggaagaaagtatatgccccaccgtgatgagtacaaacacacagcatcagggaagccacacagaatgaagctctgagaagactgttagcattttccctccacgccccaggggaaaaggttggttctctaacttgatgtatacaaattttctgagaagattatttaaaaagtagtttccacccaatccaaggattccgattcagcagggctgaggtactccgaagcagggtatggattctgctttcatcttccaatgcaagcctgtttccacagggttgagatctggcatggacaatttcagcctgaaacgattacttttggaaatttgcagatattgttaacttcttagtcctttgaagaaaaatcaaattttttcttaagaagagacttttgaaactcacaatatgaattcaagaagcaaaaaagaaaatcgaatttcacaaatgggataccaatagcttggaaaaatccattgcttttgcagggtttgttattgagggaaccctgcctttcccagcatccttaacatttcttcctcaaataaaagaggcacattgatttgaatagttaaagatttgtctcatttccttgccaaggaggattatgtttccagctttttgttaattctgggcatttcaaccactgcttctgataacatcctgctttactgtgctaggcattccttggacccaggactggggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggtaccctaatgacaagttcaccccagtgttttctgaggagtctacctggaaatgagaaccatctgtccttcctatagtagttcttctcagaatgccgactctatgctaatggtgtagttattattcaatttataatttggcatcctaccatatatataatttaacatctactcttttaaccagcttaggacttgtcaacccactgcttgttctgtgttccacactggtattcaaagatgtgaaagcaagaagaaggctaggatgagcaacacaacagaataactcaagcaacagagcaattctgaaacacaaggaaaaaggacttactcatacttccctcatggattatctgagaattgaatgaaaacaatcagtaatgtattcaattcataacaaatgtcannagtgaaaagaacagagaactgacaaaagctaaaactacncaaagtgagatttgctcatgcnttatgtaaacaggaaaaaataaaatcctgggaatttgtatgggtaactgcactggctattgagagatcaaatgatatgcaccttcaggaactcttccagcaagagctactcagtgaggagacattcatcattagcacattcagaaattatagctctgatatgttttctgggtggccggatgcaaaggatcatccatagttatgaaaactcaagaacagggaagtcaattagtatatttataaatctgtattcctctcctgtcaaggaatctccctgtatatgaatgatagctgtgtccttgatttgagtaactctttttcctaatcaaaagaaactcaaatgaacaggcccatatgtcttatcagaacaaactatcctgtaataaaatggaaagaggtttt

SEQ ID NO: 419647 - DNA, 2496 bp, Homo sapiens
  misc_feature (2033)..(2034): n is a, c, g, or t
  misc_feature (2073)..(2073): n is a, c, g, or t
  misc_feature (2095)..(2095): n is a, c, g, or t
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccaggtattctccactggttgaatgcaaatggaagccagaggaaaagggaacccttgacacagttttcatatagattggcctccagggcagacagcagattccaagaaccaggaggttgtttgctgtactctcccttgtacagttagctgtctctagtgcctgaatgcactaattgtcctttgggtatggatgaggtaatgaaggaaagggatgctgggaagagaggccacatgagaaggctgcagcaaactaagtgttgcttgctaaagaaaaatgaaagctggaatttcagcagggaagaaagtatatgccccaccgtgatgagtacaaacacacagcatcagggaagccacacagaatgaagctctgagaagactgttagcattttccctccacgccccaggggaaaaggttggttctctaacttgatgtatacaaattttctgagaagattatttaaaaagtagtttccacccaatccaaggattccgattcagcagggctgaggtactccgaagcagggtatggattctgctttcatcttccaatgcaagcctgtttccacagggttgagatctggcatggacaatttcagcctgaaacgattacttttggaaatttgcagatattgttaacttcttagtcctttgaagaaaaatcaaattttttcttaagaagagacttttgaaactcacaatatgaattcaagaagcaaaaaagaaaatcgaatttcacaaatgggataccaatagcttggaaaaatccattgcttttgcagggtttgttattgagggaaccctgcctttcccagcatccttaacatttcttcctcaaataaaagaggcacattgatttgaatagttaaagatttgtctcatttccttgccaaggaggattatgtttccagctttttgttaattctgggcatttcaaccactgcttctgataacatcctgctttactgtgctaggcattccttggacccaggactggggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggtaccctaatgacaagttcaccccagtgttttctgaggagtctacctggaaatgagaaccatctgtccttcctatagtagttcttctcagaatgccgactctatgctaatggtgtagttattattcaatttataatttggcatcctaccatatatataatttaacatctactcttttaaccagcttaggacttgtcaacccactgcttgttctgtgttccacactggtattcaaagatgtgaaagcaagaagaaggctaggatgagcaacacaacagaataactcaagcaacagagcaattctgaaacacaaggaaaaaggacttactcatacttccctcatggattatctgagaattgaatgaaaacaatcagtaatgtattcaattcataacaaatgtcannagtgaaaagaacagagaactgacaaaagctaaaactacncaaagtgagatttgctcatgcnttatgtaaacaggaaaaaataaaatcctgggaatttgtatgggtaactgcactggctattgagagatcaaatgatatgcaccttcaggaactcttccagcaagagctactcagtgaggagacattcatcattagcacattcagaaattatagctctgatatgttttctgggtggccggatgcaaaggatcatccatagttatgaaaactcaagaacagggaagtcaattagtatatttataaatctgtattcctctcctgtcaaggaatctccctgtatatgaatgatagctgtgtccttgatttgagtaactctttttcctaatcaaaagaaactcaaatgaacaggcccatatgtcttatcagaacaaactatcctgtaataaaatggaaagaggtttt

SEQ ID NO: 419648 - DNA, 2880 bp, Homo sapiens
  misc_feature (55)..(55): n is a, c, g, or t
cagcatcatgtaagatgtgcctgctcccccttccgccatgattgtaagtttcccnaggcctcctcagccatgtggaactatgagaaaactgaagataagaaaaattctgcagcttgcctagaatatggctgctagcaaatgttgtaaaggaactcagatctgcccattcccagagcctgaggtcttaatctattctgctgacttaaattctgtatcatgagtttcacaacctgaagcttgggaactcctgtggagccctggagtgatgtttaaggaatacttcagtgagctgtacacactacaactcccatattgcattttagtttttaaaaatagtttctttaaaataaatgcaagaggggtctctgaacaatatgctcaggtctccaaactggctgaatttaccacggactatttttctagcatttggattttaacagaagcagagcaaagttgggatgaccacacccttcctgggcttcaaggactttaaaaatgtcctggctgccccagaagttggagagctctacatttcagcgttggtggtattctccactggttgaatgcaaatggaagccagaggaaaagggaacccttgacacagttttcatatagattggcctccagggcagacagcagattccaagaaccaggaggttgtttgctgtactctcccttgtacagttagctgtctctagtgcctgaatgcactaattgtcctttgggtatggatgaggtaatgaaggaaagggatgctgggaagagaggccacatgagaagtggttctctaacttgatgtatacaaattttctgagaagattatttaaaaagtagtttccacccaatccaaggattccgattcagcagggctgaggtactccgaagcagggtatggattctgctttcatcttccaatgcaagcctgtttccacagggttgagatctggcatggacaatttcagcctgaaacgattacttttggaaatttgcagtgagtggaaacagtcatgtagagctgtggatcttgctacctggatcaataacttcttctagttaagcttcttgccaaggaaaagcaaggaatatcaaatttcatagacctaatgaaccactggaaactgcttgcacccatgtgtgcaaggatcgctttttatgatttatacaaaccaaagcactcattggaataagaataatagctaacgtttatttatcatttattatcctggccactgtgccaagtatttatatacagtgagttatttaatccctgcaacaacccatgggtaggtactattatttttccttctttatagataagaacattgaggcacaaaaatgctaaattacagagtgggatcaatgtgttgctcgcttagaaaatgagtcaagttccatatgtgtgagtaaatgtgaacattcccacttccttgtcacttggttttctttctcaagtttggtgtgtttgctctgtgttcacaggatattgttaacttcttagtcctttgaagaaaaatcaaattttttcttaagaagagacttttgaaactcacaatatgaattcaagaagcaaaaaagaaaatcgaatttcacaaatgggataccaatagcttggaaaaatccattgcttttgcagggtttgttattgagggaaccctgcctttcccagcatccttaacatttcttcctcaaataaaagaggcacattgatttgaatagttaaagatttgtctcatttccttgccaaggaggattatgtttccagctttttgttaattctgggcatttcaaccactgcttctgataacatcctgctttactgtgctaggcattccttggacccaggactggggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggtaccctaatgacaagttcaccccagtgttttctgaggagtctacctggaaatgagaaccatctgtccttcctatagtagttcttctcagaatgccgactctatgctaatggaaccttcagaaagggcagaaaggaagtttacttctgcctctacaatggatttgcctactttagacatgttttcaagatttatccacgtcatggcatataccagaacttcatttcttttatgattgaataatattacatggttttaatatactatattttgtttatctgttcatcaattaataaatctttgggttgttttcacttttaggctataataattaacgctgttaggaatatttacttgtaagtttttgttatatgtttttaattctcctgggtagatacttagggataaaattgctgaattagattgtaactttatgtttagaaactgcccaactgttttccaaagtaactatcattttaatatttcaccagcattgtatgacagttctggtctttccttatttaaactaatacttaattattgccttttattgtagctatcctagtagatatgaagtgttatctcattatggttttgatttgcattctctaatgactaataatatcaagcatcttttcatgtgtatacaagatatttgtatatcttctttagagaaatgtctactcaaatcctgtgcctatgttttaattggataatttatgtttttattgttgagttgtaatagtttttaaatatattctggatcctagacctttaaca

SEQ ID NO: 419649 - DNA, 2206 bp, Homo sapiens
  misc_feature (1743)..(1744): n is a, c, g, or t
  misc_feature (1783)..(1783): n is a, c, g, or t
  misc_feature (1805)..(1805): n is a, c, g, or t
ccaaagaaaaattatccttatcagtgatgtctgcctggtggctggtgaatggtaaaaactggcaggagagaccaatccgatgggaaatcaagttcaggtattctccactggttgaatgcaaatggaagccagaggaaaagggaacccttgacacagttttcatatagattggcctccagggcagacagcagattccaagaaccaggaggttgtttgctgtactctcccttgtacagttagctgtctctagtgcctgaatgcactaattgtcctttgggtatggatgaggtaatgaaggaaagggatgctgggaagagaggccacatgagaaggctgcagcaaactaagtgttgcttgctaaagaaaaatgaaagctggaatttcagcagggaagaaagtatatgccccaccgtgatgagtacaaacacacagcatcagggaagccacacagaatgaagctctgagaagactgttagcattttccctccacgccccaggggaaaaggttggttctctaacttgatgtatacaaattttctgagaagattatttaaaaagtagtttccacccaatccaaggattccgattcagcagggctgaggtactccgaagcagggtatggattctgctttcatcttccaatgcaagcctgtttccacagggttgagatctggcatggacaatttcagcctgaaacgattacttttggaaatttgcagatattgttaacttcttagtcctttgaagaaaaatcaaattttttcttaagaagagacttttgaaactcacaatatgaattcaagaagcaaaaaagaaaatcgaatttcacaaatgggataccaatagcttggaaaaatccattgcttttgcagggtttgttattgagggaaccctgcctttcccagcatccttaacatttcttcctcaaataaaagaggcacattgatttgaatagttaaagatttgtctcatttccttgccaaggaggattatgtttccagctttttgttaattctgggcatttcaaccactgcttctgataacatcctgctttactgtgctaggcattccttggacccaggactggggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggtaccctaatgacaagttcaccccagtgttttctgaggagtctacctggaaatgagaaccatctgtccttcctatagtagttcttctcagaatgccgactctatgctaatggtgtagttattattcaatttataatttggcatcctaccatatatataatttaacatctactcttttaaccagcttaggacttgtcaacccactgcttgttctgtgttccacactggtattcaaagatgtgaaagcaagaagaaggctaggatgagcaacacaacagaataactcaagcaacagagcaattctgaaacacaaggaaaaaggacttactcatacttccctcatggattatctgagaattgaatgaaaacaatcagtaatgtattcaattcataacaaatgtcannagtgaaaagaacagagaactgacaaaagctaaaactacncaaagtgagatttgctcatgcnttatgtaaacaggaaaaaataaaatcctgggaatttgtatgggtaactgcactggctattgagagatcaaatgatatgcaccttcaggaactcttccagcaagagctactcagtgaggagacattcatcattagcacattcagaaattatagctctgatatgttttctgggtggccggatgcaaaggatcatccatagttatgaaaactcaagaacagggaagtcaattagtatatttataaatctgtattcctctcctgtcaaggaatctccctgtatatgaatgatagctgtgtccttgatttgagtaactctttttcctaatcaaaagaaactcaaatgaacaggcccatatgtcttatcagaacaaactatcctgtaataaaatggaaagaggtttt

SEQ ID NO: 419650 - DNA, 1944 bp, Homo sapiens
  misc_feature (55)..(55): n is a, c, g, or t
  misc_feature (1944)..(1944): n is a, c, g, or t
cagcatcatgtaagatgtgcctgctcccccttccgccatgattgtaagtttcccnaggcctcctcagccatgtggaactatgagaaaactgaagataagaaaaattctgcagcttgcctagaatatggctgctagcaaatgttgtaaaggaactcagatctgcccattcccagagcctgaggtcttaatctattctgctgacttaaattctgtatcatgagtttcacaacctgaagcttgggaactcctgtggagccctggagtgatgtttaaggaatacttcagtgagctgtacacactacaactcccatattgcattttagtttttaaaaatagtttctttaaaataaatgcaagaggggtctctgaacaatatgctcaggtctccaaactggctgaatttaccacggactatttttctagcatttggattttaacagaagcagagcaaagttgggatgaccacacccttcctgggcttcaaggactttaaaaatgtcctggctgccccagaagttggagagctctacatttcagcgttggtggtattctccactggttgaatgcaaatggaagccagaggaaaagggaacccttgacacagttttcatatagattggcctccagggcagacagcagattccaagaaccaggaggttgtttgctgtactctcccttgtacagttagctgtctctagtgcctgaatgcactaattgtcctttgggtatggatgaggtaatgaaggaaagggatgctgggaagagaggccacatgagaagtggttctctaacttgatgtatacaaattttctgagaagattatttaaaaagtagtttccacccaatccaaggattccgattcagcagggctgaggtactccgaagcagggtatggattctgctttcatcttccaatgcaagcctgtttccacagggttgagatctggcatggacaatttcagcctgaaacgattacttttggaaatttgcagtgagtggaaacagtcatgtagagctgtggatcttgctacctggatcaataacttcttctagttaagcttcttgccaaggaaaagcaaggaatatcaaatttcatagacctaatgaaccactggaaactgcttgcacccatgtgtgcaaggatcgctttttatgatttatacaaaccaaagcactcattggaataagaataatagctaacgtttatttatcatttattatcctggccactgtgccaagtatttatatacagtgagttatttaatccctgcaacaacccatgggtaggtactattatttttccttctttatagataagaacattgaggcacaaaaatgctaaattacagagtgggatcaatgtgttgctcgcttagaaaatgagtcaagttccatatgtgtgagtaaatgtgaacattcccacttccttgtcacttggttttctttctcaagtttggtgtgtttgctctgtgttcacaggatattgttaacttcttagtcctttgaagaaaaatcaaattttttcttaagaagagacttttgaaactcacaatatgaattcaagaagcaaaaaagaaaatcgaatttcacaaatgggataccaatagcttggaaaaatccattgcttttgcagggtttgttattgagggaaccctgcctttcccagcatccttaacatttcttcctcaaataaaaggtaataaaatgcaaccaactgactcattttctaagtgaatgacatatttactctactctttaagtttaaactctaagcaattccccaatccttagttcccatgaaatgtaatgttctcttcctaaaatgtttggccaagttggggaaggtgggcatggcagtgtgagcctgtagccaggttccaaggttcgcttgaggttaggaggttgagactagcctgggcaatatggcaagactctgtatccacn

SEQ ID NO: 419651 - DNA, 2136 bp, Homo sapiens
  misc_feature (1673)..(1674): n is a, c, g, or t
  misc_feature (1713)..(1713): n is a, c, g, or t
  misc_feature (1735)..(1735): n is a, c, g, or t
cttccaaaccaacatgtgtgaaacatagtattctccactggttgaatgcaaatggaagccagaggaaaagggaacccttgacacagttttcatatagattggcctccagggcagacagcagattccaagaaccaggaggttgtttgctgtactctcccttgtacagttagctgtctctagtgcctgaatgcactaattgtcctttgggtatggatgaggtaatgaaggaaagggatgctgggaagagaggccacatgagaaggctgcagcaaactaagtgttgcttgctaaagaaaaatgaaagctggaatttcagcagggaagaaagtatatgccccaccgtgatgagtacaaacacacagcatcagggaagccacacagaatgaagctctgagaagactgttagcattttccctccacgccccaggggaaaaggttggttctctaacttgatgtatacaaattttctgagaagattatttaaaaagtagtttccacccaatccaaggattccgattcagcagggctgaggtactccgaagcagggtatggattctgctttcatcttccaatgcaagcctgtttccacagggttgagatctggcatggacaatttcagcctgaaacgattacttttggaaatttgcagatattgttaacttcttagtcctttgaagaaaaatcaaattttttcttaagaagagacttttgaaactcacaatatgaattcaagaagcaaaaaagaaaatcgaatttcacaaatgggataccaatagcttggaaaaatccattgcttttgcagggtttgttattgagggaaccctgcctttcccagcatccttaacatttcttcctcaaataaaagaggcacattgatttgaatagttaaagatttgtctcatttccttgccaaggaggattatgtttccagctttttgttaattctgggcatttcaaccactgcttctgataacatcctgctttactgtgctaggcattccttggacccaggactggggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggtaccctaatgacaagttcaccccagtgttttctgaggagtctacctggaaatgagaaccatctgtccttcctatagtagttcttctcagaatgccgactctatgctaatggtgtagttattattcaatttataatttggcatcctaccatatatataatttaacatctactcttttaaccagcttaggacttgtcaacccactgcttgttctgtgttccacactggtattcaaagatgtgaaagcaagaagaaggctaggatgagcaacacaacagaataactcaagcaacagagcaattctgaaacacaaggaaaaaggacttactcatacttccctcatggattatctgagaattgaatgaaaacaatcagtaatgtattcaattcataacaaatgtcannagtgaaaagaacagagaactgacaaaagctaaaactacncaaagtgagatttgctcatgcnttatgtaaacaggaaaaaataaaatcctgggaatttgtatgggtaactgcactggctattgagagatcaaatgatatgcaccttcaggaactcttccagcaagagctactcagtgaggagacattcatcattagcacattcagaaattatagctctgatatgttttctgggtggccggatgcaaaggatcatccatagttatgaaaactcaagaacagggaagtcaattagtatatttataaatctgtattcctctcctgtcaaggaatctccctgtatatgaatgatagctgtgtccttgatttgagtaactctttttcctaatcaaaagaaactcaaatgaacaggcccatatgtcttatcagaacaaactatcctgtaataaaatggaaagaggtttt

SEQ ID NO: 419652 - DNA, 2569 bp, Homo sapiens
  misc_feature (55)..(55): n is a, c, g, or t
cagcatcatgtaagatgtgcctgctcccccttccgccatgattgtaagtttcccnaggcctcctcagccatgtggaactatgagaaaactgaagataagaaaaattctgcagcttgcctagaatatggctgctagcaaatgttgtaaaggaactcagatctgcccattcccagagcctgaggtcttaatctattctgctgacttaaattctgtatcatgagtttcacaacctgaagcttgggaactcctgtggagccctggagtgatgtttaaggaatacttcagtgagctgtacacactacaactcccatattgcattttagtttttaaaaatagtttctttaaaataaatgcaagaggggtctctgaacaatatgctcaggtctccaaactggctgaatttaccacggactatttttctagcatttggattttaacagaagcagagcaaagttgggatgaccacacccttcctgggcttcaaggactttaaaaatgtcctggctgccccagaagttggagagctctacatttcagcgttggtggtattctccactggttgaatgcaaatggaagccagaggaaaagggaacccttgacacagttttcatatagattggcctccagggcagacagcagattccaagaaccaggaggttgtttgctgtactctcccttgtacagttagctgtctctagtgcctgaatgcactaattgtcctttgggtatggatgaggtaatgaaggaaagggatgctgggaagagaggccacatgagaagtggttctctaacttgatgtatacaaattttctgagaagattatttaaaaagtagtttccacccaatccaaggattccgattcagcagggctgaggtactccgaagcagggtatggattctgctttcatcttccaatgcaagcctgtttccacagggttgagatctggcatggacaatttcagcctgaaacgattacttttggaaatttgcagtgagtggaaacagtcatgtagagctgtggatcttgctacctggatcaataacttcttctagttaagcttcttgccaaggaaaagcaaggaatatcaaatttcatagacctaatgaaccactggaaactgcttgcacccatgtgtgcaaggatcgctttttatgatttatacaaaccaaagcactcattggaataagaataatagctaacgtttatttatcatttattatcctggccactgtgccaagtatttatatacagtgagttatttaatccctgcaacaacccatgggtaggtactattatttttccttctttatagataagaacattgaggcacaaaaatgctaaattacagagtgggatcaatgtgttgctcgcttagaaaatgagtcaagttccatatgtgtgagtaaatgtgaacattcccacttccttgtcacttggttttctttctcaagtttggtgtgtttgctctgtgttcacaggatattgttaacttcttagtcctttgaagaaaaatcaaattttttcttaagaagagacttttgaaactcacaatatgaattcaagaagcaaaaaagaaaatcgaatttcacaaatgggataccaatagcttggaaaaatccattgcttttgcagggtttgttattgagggaaccctgcctttcccagcatccttaacatttcttcctcaaataaaagaggcacattgatttgaatagttaaagatttgtctcatttccttgccaaggaggattatgtttccagctttttgttaattctgggcatttcaaccactgcttctgataacatcctgctttactgtgctaggcattccttggacccaggactggggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggtaccctaatgacaagttcaccccagtgttttctgaggagtctacctggaaatgagaaccatctgtccttcctatagtagttcttctcagaatgccgactctatgctaatgaacttatgatctggtggaaggacatgataactaatcaaataatcacaaatatgtatttcagagaaatgaggggcaaatgcactagctgccctatgtaagctctaagtctcatcatttcggggatcctctcctgtgatgcagctttgctagaaagaactaatatttgtatttttttgcaccatctgttctgctgtatcgtggtagaagtcatgtaggttcatatgagatctttcttccaagcaccttaatgttttgaagagataaaagcaagaagcaagctttcttacaattcatgaaaaagcccaatcaatatgcctcaagaaacaaagctgatgtataataaaaattattatccca

SEQ ID NO: 419653 - DNA, 2488 bp, Homo sapiens
  misc_feature (55)..(55): n is a, c, g, or t
  misc_feature (2149)..(2149): n is a, c, g, or t
cagcatcatgtaagatgtgcctgctcccccttccgccatgattgtaagtttcccnaggcctcctcagccatgtggaactatgagaaaactgaagataagaaaaattctgcagcttgcctagaatatggctgctagcaaatgttgtaaaggaactcagatctgcccattcccagagcctgaggtcttaatctattctgctgacttaaattctgtatcatgagtttcacaacctgaagcttgggaactcctgtggagccctggagtgatgtttaaggaatacttcagtgagctgtacacactacaactcccatattgcattttagtttttaaaaatagtttctttaaaataaatgcaagaggggtctctgaacaatatgctcaggtctccaaactggctgaatttaccacggactatttttctagcatttggattttaacagaagcagagcaaagttgggatgaccacacccttcctgggcttcaaggactttaaaaatgtcctggctgccccagaagttggagagctctacatttcagcgttggtggtattctccactggttgaatgcaaatggaagccagaggaaaagggaacccttgacacagttttcatatagattggcctccagggcagacagcagattccaagaaccaggaggttgtttgctgtactctcccttgtacagttagctgtctctagtgcctgaatgcactaattgtcctttgggtatggatgaggtaatgaaggaaagggatgctgggaagagaggccacatgagaagtggttctctaacttgatgtatacaaattttctgagaagattatttaaaaagtagtttccacccaatccaaggattccgattcagcagggctgaggtactccgaagcagggtatggattctgctttcatcttccaatgcaagcctgtttccacagggttgagatctggcatggacaatttcagcctgaaacgattacttttggaaatttgcagtgagtggaaacagtcatgtagagctgtggatcttgctacctggatcaataacttcttctagttaagcttcttgccaaggaaaagcaaggaatatcaaatttcatagacctaatgaaccactggaaactgcttgcacccatgtgtgcaaggatcgctttttatgatttatacaaaccaaagcactcattggaataagaataatagctaacgtttatttatcatttattatcctggccactgtgccaagtatttatatacagtgagttatttaatccctgcaacaacccatgggtaggtactattatttttccttctttatagataagaacattgaggcacaaaaatgctaaattacagagtgggatcaatgtgttgctcgcttagaaaatgagtcaagttccatatgtgtgagtaaatgtgaacattcccacttccttgtcacttggttttctttctcaagtttggtgtgtttgctctgtgttcacaggatattgttaacttcttagtcctttgaagaaaaatcaaattttttcttaagaagagacttttgaaactcacaatatgaattcaagaagcaaaaaagaaaatcgaatttcacaaatgggataccaatagcttggaaaaatccattgcttttgcagggtttgttattgagggaaccctgcctttcccagcatccttaacatttcttcctcaaataaaagaggcacattgatttgaatagttaaagatttgtctcatttccttgccaaggaggattatgtttccagctttttgttaattctgggcatttcaaccactgcttctgataacatcctgctttactgtgctaggcattccttggacccaggactggggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggctggagtgcaatggcgtgatctcggctcactgcaacctctgccttcnggtttcaagcaattctcctgcctcagcctcctgagtagctgggattacaggcacccaccaccacgcctggctaatttttgtatttttagtagagacagggtttcaccgtgttgttcaggctggtctcgagctcctgacctcgtgatccgaccacctcagcctcctaaaatgctgggattacaggcgtgagccaccgcgccggccaaggcaatgatttttaatggtttttgggaagcagattttataatatattaaaggaggtgtgtgtgtgtgtgtgtgtgggtacgtaatacatacaaatatatccattcatcttttaataaactaggttcagcatcc

SEQ ID NO: 419654 - DNA, 1586 bp, Homo sapiens
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactggtgctgcgttgccatctttaaagtcatcacactggaccacatcagtattgcaagctgcttgggtatcattaatgaagacaaagtgggattattattttctatgatttgggcttttgagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggtaccctaatgacaagttcaccccagtgttttctgaggagtctacctggaaatgagaaccatctgtccttcctatagtagttcttctcagaatgccgactctatgctaatggaaccttcagaaagggcagaaaggaagtttacttctgcctctacaatggatttgcctactttagacatgttttcaagatttatccacgtcatggcatataccagaacttcatttcttttatgattgaataatattacatggttttaatatactatattttgtttatctgttcatcaattaataaatctttgggttgttttcacttttaggctataataattaacgctgttaggaatatttacttgtaagtttttgttatatgtttttaattctcctgggtagatacttagggataaaattgctgaattagattgtaactttatgtttagaaactgcccaactgttttccaaagtaactatcattttaatatttcaccagcattgtatgacagttctggtctttccttatttaaactaatacttaattattgccttttattgtagctatcctagtagatatgaagtgttatctcattatggttttgatttgcattctctaatgactaataatatcaagcatcttttcatgtgtatacaagatatttgtatatcttctttagagaaatgtctactcaaatcctgtgcctatgttttaattggataatttatgtttttattgttgagttgtaatagtttttaaatatattctggatcctagacctttaaca

SEQ ID NO: 419655 - DNA, 2496 bp, Homo sapiens
  misc_feature (55)..(55): n is a, c, g, or t
cagcatcatgtaagatgtgcctgctcccccttccgccatgattgtaagtttcccnaggcctcctcagccatgtggaactatgagaaaactgaagataagaaaaattctgcagcttgcctagaatatggctgctagcaaatgttgtaaaggaactcagatctgcccattcccagagcctgaggtcttaatctattctgctgacttaaattctgtatcatgagtttcacaacctgaagcttgggaactcctgtggagccctggagtgatgtttaaggaatacttcagtgagctgtacacactacaactcccatattgcattttagtttttaaaaatagtttctttaaaataaatgcaagaggggtctctgaacaatatgctcaggtctccaaactggctgaatttaccacggactatttttctagcatttggattttaacagaagcagagcaaagttgggatgaccacacccttcctgggcttcaaggactttaaaaatgtcctggctgccccagaagttggagagctctacatttcagcgttggtggtattctccactggttgaatgcaaatggaagccagaggaaaagggaacccttgacacagttttcatatagattggcctccagggcagacagcagattccaagaaccaggaggttgtttgctgtactctcccttgtacagttagctgtctctagtgcctgaatgcactaattgtcctttgggtatggatgaggtaatgaaggaaagggatgctgggaagagaggccacatgagaagtggttctctaacttgatgtatacaaattttctgagaagattatttaaaaagtagtttccacccaatccaaggattccgattcagcagggctgaggtactccgaagcagggtatggattctgctttcatcttccaatgcaagcctgtttccacagggttgagatctggcatggacaatttcagcctgaaacgattacttttggaaatttgcagtgagtggaaacagtcatgtagagctgtggatcttgctacctggatcaataacttcttctagttaagcttcttgccaaggaaaagcaaggaatatcaaatttcatagacctaatgaaccactggaaactgcttgcacccatgtgtgcaaggatcgctttttatgatttatacaaaccaaagcactcattggaataagaataatagctaacgtttatttatcatttattatcctggccactgtgccaagtatttatatacagtgagttatttaatccctgcaacaacccatgggtaggtactattatttttccttctttatagataagaacattgaggcacaaaaatgctaaattacagagtgggatcaatgtgttgctcgcttagaaaatgagtcaagttccatatgtgtgagtaaatgtgaacattcccacttccttgtcacttggttttctttctcaagtttggtgtgtttgctctgtgttcacaggatattgttaacttcttagtcctttgaagaaaaatcaaattttttcttaagaagagacttttgaaactcacaatatgaattcaagaagcaaaaaagaaaatcgaatttcacaaatgggataccaatagcttggaaaaatccattgcttttgcagggtttgttattgagggaaccctgcctttcccagcatccttaacatttcttcctcaaataaaagaggcacattgatttgaatagttaaagatttgtctcatttccttgccaaggaggattatgtttccagctttttgttaattctgggcatttcaaccactgcttctgataacatcctgctttactgtgctaggcattccttggacccaggactggggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggtaccctaatgacaagttcaccccagtgttttctgaggagtctacctggaaatgagaaccatctgtccttcctatagtagttcttctcagaatgccgactctatgctaatggaaagaagtgagatgatgatggctctgtctcagcagctctcggggggacctgcaggctggggaggcagcttctctctgcaatttggccgctcctggacttgttgcagccaggcttcaaagagaaaccaccgcttcctccccgagccccacgccagcctcagaggcagctgggcctattgaaacattcaagtttcacttcaggctactttaaacatttgctttattccaaaacagctaaacttggagttattttcaaatataggccatttttatgccccagtata

SEQ ID NO: 419656 - DNA, 2805 bp, Homo sapiens
  misc_feature (55)..(55): n is a, c, g, or t
  misc_feature (2316)..(2316): n is a, c, g, or t
  misc_feature (2318)..(2318): n is a, c, g, or t
cagcatcatgtaagatgtgcctgctcccccttccgccatgattgtaagtttcccnaggcctcctcagccatgtggaactatgagaaaactgaagataagaaaaattctgcagcttgcctagaatatggctgctagcaaatgttgtaaaggaactcagatctgcccattcccagagcctgaggtcttaatctattctgctgacttaaattctgtatcatgagtttcacaacctgaagcttgggaactcctgtggagccctggagtgatgtttaaggaatacttcagtgagctgtacacactacaactcccatattgcattttagtttttaaaaatagtttctttaaaataaatgcaagaggggtctctgaacaatatgctcaggtctccaaactggctgaatttaccacggactatttttctagcatttggattttaacagaagcagagcaaagttgggatgaccacacccttcctgggcttcaaggactttaaaaatgtcctggctgccccagaagttggagagctctacatttcagcgttggtggtattctccactggttgaatgcaaatggaagccagaggaaaagggaacccttgacacagttttcatatagattggcctccagggcagacagcagattccaagaaccaggaggttgtttgctgtactctcccttgtacagttagctgtctctagtgcctgaatgcactaattgtcctttgggtatggatgaggtaatgaaggaaagggatgctgggaagagaggccacatgagaagtggttctctaacttgatgtatacaaattttctgagaagattatttaaaaagtagtttccacccaatccaaggattccgattcagcagggctgaggtactccgaagcagggtatggattctgctttcatcttccaatgcaagcctgtttccacagggttgagatctggcatggacaatttcagcctgaaacgattacttttggaaatttgcagtgagtggaaacagtcatgtagagctgtggatcttgctacctggatcaataacttcttctagttaagcttcttgccaaggaaaagcaaggaatatcaaatttcatagacctaatgaaccactggaaactgcttgcacccatgtgtgcaaggatcgctttttatgatttatacaaaccaaagcactcattggaataagaataatagctaacgtttatttatcatttattatcctggccactgtgccaagtatttatatacagtgagttatttaatccctgcaacaacccatgggtaggtactattatttttccttctttatagataagaacattgaggcacaaaaatgctaaattacagagtgggatcaatgtgttgctcgcttagaaaatgagtcaagttccatatgtgtgagtaaatgtgaacattcccacttccttgtcacttggttttctttctcaagtttggtgtgtttgctctgtgttcacaggatattgttaacttcttagtcctttgaagaaaaatcaaattttttcttaagaagagacttttgaaactcacaatatgaattcaagaagcaaaaaagaaaatcgaatttcacaaatgggataccaatagcttggaaaaatccattgcttttgcagggtttgttattgagggaaccctgcctttcccagcatccttaacatttcttcctcaaataaaagaggcacattgatttgaatagttaaagatttgtctcatttccttgccaaggaggattatgtttccagctttttgttaattctgggcatttcaaccactgcttctgataacatcctgctttactgtgctaggcattccttggacccaggactggggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggtttaggtgcagtcatcttggatttgagtcgtgcttgtgaattttcatgtgttacaacaaccagattaaatttcttcaagtggaaatattaagtcaaagaaattacctatttctaataattcttactgaagaagtgaaacctagcaggaagaattgtatttggttctggaggttggaagtctgagaccagggtgtgactgtggttgggttctggngngagcgtctttggtttgttgacagtcaccttcttgctgtgtcctcatgtgaggggaagtagagggagaaaaagctctctggtgtctttttttataagggcactaatcacatcatgaaagccccaccctcaaaacctcgtctaagcctatttatctcccaaaggccccatctccaaattccatcacattggagcttagggcttccacctatgaatctttctggggtgcagtatggttcagtctatagcagaaaaaaataataaaaaaaatatatatatgtacacacacacatatatatatataatttatattcatgtatacttgtatagttgaaagtctccaagataatgaacaaaatgctgaatggttatttctgggtcatagaaggagagcaaattctagaacttttttctttttgtttctctgtgttttccaagttttattcactgagcatgtactaccattgtgtttataaaatattaaattttt

SEQ ID NO: 419657 - DNA, 1506 bp, Homo sapiens
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccaggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggaggaggtctgatggccgggaggacaggaagaaggaacccacaatgaagcaaaagttgcgtttaactctgtcctcaccattcctctcctggacctgtcctaaactggaagctgggggaggatggagtgctggaatgctgcagaagtctcatgggagggcgcctggtgttcaccacatgtgtacactgttgcacgaccaggaaccttcagaaagggcagaaaggaagtttacttctgcctctacaatggatttgcctactttagacatgttttcaagatttatccacgtcatggcatataccagaacttcatttcttttatgattgaataatattacatggttttaatatactatattttgtttatctgttcatcaattaataaatctttgggttgttttcacttttaggctataataattaacgctgttaggaatatttacttgtaagtttttgttatatgtttttaattctcctgggtagatacttagggataaaattgctgaattagattgtaactttatgtttagaaactgcccaactgttttccaaagtaactatcattttaatatttcaccagcattgtatgacagttctggtctttccttatttaaactaatacttaattattgccttttattgtagctatcctagtagatatgaagtgttatctcattatggttttgatttgcattctctaatgactaataatatcaagcatcttttcatgtgtatacaagatatttgtatatcttctttagagaaatgtctactcaaatcctgtgcctatgttttaattggataatttatgtttttattgttgagttgtaatagtttttaaatatattctggatcctagacctttaaca

SEQ ID NO: 419658 - DNA, 1404 bp, Homo sapiens
atggcgggcgcccctcccccagcctcgctgccgccttgcagtttgatctcggactgctgtgctagcaatcagcgagactccgtgggcgtagcaccctccgagccaggtgcgggatataatctggtggtgcaccgttttttaagctggtccgaaaagcgcagtattcgggtgggagtgacccgattttccaggtattctccactggttgaatgcaaatggaagccagaggaaaagggaacccttgacacagttttcatatagattggcctccagggcagacagcaggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggaggaggtctgatggccgggaggacaggaagaaggaacccacaatgaagcaaaagttgcgtttaactctgtcctcaccattcctctcctggacctgtcctaaactggaagctgggggaggatggagtgctggaatgctgcagaagtctcatgggagggcgcctggtgttcaccacatgtgtacactgttgcacgaccaggaaccttcagaaagggcagaaaggaagtttacttctgcctctacaatggatttgcctactttagacatgttttcaagatttatccacgtcatggcatataccagaacttcatttcttttatgattgaataatattacatggttttaatatactatattttgtttatctgttcatcaattaataaatctttgggttgttttcacttttaggctataataattaacgctgttaggaatatttacttgtaagtttttgttatatgtttttaattctcctgggtagatacttagggataaaattgctgaattagattgtaactttatgtttagaaactgcccaactgttttccaaagtaactatcattttaatatttcaccagcattgtatgacagttctggtctttccttatttaaactaatacttaattattgccttttattgtagctatcctagtagatatgaagtgttatctcattatggttttgatttgcattctctaatgactaataatatcaagcatcttttcatgtgtatacaagatatttgtatatcttctttagagaaatgtctactcaaatcctgtgcctatgttttaattggataatttatgtttttattgttgagttgtaatagtttttaaatatattctggatcctagacctttaaca

SEQ ID NO: 419659 - DNA, 1626 bp, Homo sapiens
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactggtattctccactggttgaatgcaaatggaagccagaggaaaagggaacccttgacacagttttcatatagattggcctccagggcagacagcaggagtggggtttaatctggactgaattggaggaaaggaactggcaccagagtggaggctggaaggatggtggaactgacactgggacagaacacagaaaacagaatctaatgctagtaccctaatgacaagttcaccccagtgttttctgaggagtctacctggaaatgagaaccatctgtccttcctatagtagttcttctcagaatgccgactctatgctaatggaggaggtctgatggccgggaggacaggaagaaggaacccacaatgaagcaaaagttgcgtttaactctgtcctcaccattcctctcctggacctgtcctaaactggaagctgggggaggatggagtgctggaatgctgcagaagtctcatgggagggcgcctggtgttcaccacatgtgtacactgttgcacgaccaggaaccttcagaaagggcagaaaggaagtttacttctgcctctacaatggatttgcctactttagacatgttttcaagatttatccacgtcatggcatataccagaacttcatttcttttatgattgaataatattacatggttttaatatactatattttgtttatctgttcatcaattaataaatctttgggttgttttcacttttaggctataataattaacgctgttaggaatatttacttgtaagtttttgttatatgtttttaattctcctgggtagatacttagggataaaattgctgaattagattgtaactttatgtttagaaactgcccaactgttttccaaagtaactatcattttaatatttcaccagcattgtatgacagttctggtctttccttatttaaactaatacttaattattgccttttattgtagctatcctagtagatatgaagtgttatctcattatggttttgatttgcattctctaatgactaataatatcaagcatcttttcatgtgtatacaagatatttgtatatcttctttagagaaatgtctactcaaatcctgtgcctatgttttaattggataatttatgtttttattgttgagttgtaatagtttttaaatatattctggatcctagacctttaaca

SEQ ID NO: 419660 - DNA, 1490 bp, Homo sapiens
  misc_feature (1001)..(1001): n is a, c, g, or t
  misc_feature (1003)..(1003): n is a, c, g, or t
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactggtattctccactggttgaatgcaaatggaagccagaggaaaagggaacccttgacacagttttcatatagattggcctccagggcagacagcaggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggtttaggtgcagtcatcttggatttgagtcgtgcttgtgaattttcatgtgttacaacaaccagattaaatttcttcaagtggaaatattaagtcaaagaaattacctatttctaataattcttactgaagaagtgaaacctagcaggaagaattgtatttggttctggaggttggaagtctgagaccagggtgtgactgtggttgggttctggngngagcgtctttggtttgttgacagtcaccttcttgctgtgtcctcatgtgaggggaagtagagggagaaaaagctctctggtgtctttttttataagggcactaatcacatcatgaaagccccaccctcaaaacctcgtctaagcctatttatctcccaaaggccccatctccaaattccatcacattggagcttagggcttccacctatgaatctttctggggtgcagtatggttcagtctatagcagaaaaaaataataaaaaaaatatatatatgtacacacacacatatatatatataatttatattcatgtatacttgtatagttgaaagtctccaagataatgaacaaaatgctgaatggttatttctgggtcatagaaggagagcaaattctagaacttttttctttttgtttctctgtgttttccaagttttattcactgagcatgtactaccattgtgtttataaaatattaaattttt

SEQ ID NO: 419661 - DNA, 1402 bp, Homo sapiens
actcactatagggctcgagcggcctccagggcaggtgtggaagggtggggaaatagaggaaatggaagagaagaaagagagtgattttcttcatcctgtcctggatctggatcccttttaataggatctctcctggacagttctgagcacttcgaagtgcatccaattcaggtcacagtaggtgggcaaaggacttcagaccctggagacacaaaggtattctccactggttgaatgcaaatggaagccagaggaaaagggaacccttgacacagttttcatatagattggcctccagggcagacagcaggagtggggtttaatctggactgaattggaggaaaggaactggcaccagagtggaggctggaaggatggtggaactgacactgggacagaacacagaaaacagaatctaatgctagtaccctaatgacaagttcaccccagtgttttctgaggagtctacctggaaatgagaaccatctgtccttcctatagtagttcttctcagaatgccgactctatgctaatggaggaggtctgatggccgggaggacaggaagaaggaacccacaatgaagcaaaagttgcgtttaactctgtcctcaccattcctctcctggacctgtcctaaactggaagctgggggaggatggagtgctggaatgctgcagaagtctcatgggagggcgcctggtgttcaccacatgtgtacactgttgcacgaccaggaaccttcagaaagggcagaaaggaagtttacttctgcctctacaatggatttgcctactttagacatgttttcaagatttatccacgtcatggcatataccagaacttcatttcttttatgattgaataatattacatggttttaatatactatattttgtttatctgttcatcaattaataaatctttgggttgttttcacttttaggctataataattaacgctgttaggaatatttacttgtaagtttttgttatatgtttttaattctcctgggtagatacttagggataaaattgctgaattagattgtaactttatgtttagaaactgcccaactgttttccaaagtaactatcattttaatatttcaccagcattgtatgacagttctggtctttccttatttaaactaatacttaattattgccttttattgtagctatcctagtagatatgaagtgttatctcattatggttttgatttgcattctctaatgactaataatatcaagcatcttttcatgtgtatacaagatatttgtatatcttctttagagaaatgtctactcaaatcctgtgcctatgttttaattggataatttatgtttttattgttgagttgtaatagtttttaaatatattctggatcctagacctttaaca

SEQ ID NO: 419662 - DNA, 1560 bp, Homo sapiens
  misc_feature (1526)..(1526): n is a, c, g, or t
  misc_feature (1535)..(1535): n is a, c, g, or t
  misc_feature (1544)..(1544): n is a, c, g, or t
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactggtattctccactggttgaatgcaaatggaagccagaggaaaagggaacccttgacacagttttcatatagattggcctccagggcagacagcagttgctctggctatatcaaataaaagtgtcaagagtgagcatccttgccttgtgctgaatcacaaaggaatacctttcagtttttctccattgattatgatagcagtgggcttttcacagtgggctttactgtgttgaggtaccctaatgacaagttcaccccagtgttttctgaggagtctacctggaaatgagaaccatctgtccttcctatagtagttcttctcagaatgccgactctatgctaatggaggaggtctgatggccgggaggacaggaagaaggaacccacaatgaagcaaaagttgcgtttaactctgtcctcaccattcctctcctggacctgtcctaaactggaagctgggggaggatggagtgctggaatgctgcagaagtctcatgggagggcgcctggtgttcaccacatgtgtacactgttgcacgaccaggttggcactttgcatgtgggaaacgatcagagaatggtgggggatgcttaagaggcatcactggaatcctacggtaccacagaccagagccttcccttcccttcctctcccacagatggaaatttgaatgctggggctcagtggaacacctgaaggaagctggtgaggcagatgtcccgctatgccttccaagtgtcatgcaaccagttcatgcctgtcagcatctctgccggtggactctgtgagtcagcaaatctacagagcagagagccacaagtggggacagatgtggtcaaatgccatttaaatcagtgattctcaacccaggagttgtcatggcactggccttgagtgagctggaccaagggaagtggtagaattccccatgaaggaccaagtgagcagatagaagtttctccattttaactttttctgagtcaatttaaaaaacacctagtgcctttttctgtacatagtgcctgtgggtttaatttaagcctacccaaatgtgcttttatcccacctattttgaaccttgcatgtntccgggatnagaattaanataagctataaatatt

SEQ ID NO: 419663 - DNA, 1571 bp, Homo sapiens
  misc_feature (78)..(78): n is a, c, g, or t
cactgtggaagctttgttctttcgctctttgcaataaatcttgctactgctcactctttgggtccacactgcttttangagctgtaacttaccgtgaaggtctgcagcttcactcctgaagccagcgagaccacaagcccaccgggaggaaagaacaactctagatgcgcggccttaagagctgtaatactcacctggaaggtctgcagcttcactcctgagccagcgagaccacgaaccccaccagaaggaagaaactccgaacacatccgaacatcagaaggaacaaactccagacgcgccatcttaagagctgtaacactcacggcgagggtccacggcttcattcttgaagtcagtgagaccaagaacccaccaattccggacacaatgtgactagttcttgccaatgcaatgtgagcaaagcagtgtgtcatttctaggccaaggcagagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggaggaggtctgatggccgggaggacaggaagaaggaacccacaatgaagcaaaagttgcgtttaactctgtcctcaccattcctctcctggacctgtcctaaactggaagctgggggaggatggagtgctggaatgctgcagaagtctcatgggagggcgcctggtgttcaccacatgtgtacactgttgcacgaccaggaaccttcagaaagggcagaaaggaagtttacttctgcctctacaatggatttgcctactttagacatgttttcaagatttatccacgtcatggcatataccagaacttcatttcttttatgattgaataatattacatggttttaatatactatattttgtttatctgttcatcaattaataaatctttgggttgttttcacttttaggctataataattaacgctgttaggaatatttacttgtaagtttttgttatatgtttttaattctcctgggtagatacttagggataaaattgctgaattagattgtaactttatgtttagaaactgcccaactgttttccaaagtaactatcattttaatatttcaccagcattgtatgacagttctggtctttccttatttaaactaatacttaattattgccttttattgtagctatcctagtagatatgaagtgttatctcattatggttttgatttgcattctctaatgactaataatatcaagcatcttttcatgtgtatacaagatatttgtatatcttctttagagaaatgtctactcaaatcctgtgcctatgttttaattggataatttatgtttttattgttgagttgtaatagtttttaaatatattctggatcctagacctttaaca

SEQ ID NO: 419664 - DNA, 1298 bp, Homo sapiens
gtcgcttagactcctaaatgcagttcttctctctcgagaccaccttggattggagaacacccaaatgagcaggattgcttttgctttcaaaagagtgatacctggagcacaggtattctccactggttgaatgcaaatggaagccagaggaaaagggaacccttgacacagttttcatatagattggcctccagggcagacagcaggagtggggtttaatctggactgaattggaggaaaggaactggcaccagagtggaggctggaaggatggtggaactgacactgggacagaacacagaaaacagaatctaatgctagtaccctaatgacaagttcaccccagtgttttctgaggagtctacctggaaatgagaaccatctgtccttcctatagtagttcttctcagaatgccgactctatgctaatggaggaggtctgatggccgggaggacaggaagaaggaacccacaatgaagcaaaagttgcgtttaactctgtcctcaccattcctctcctggacctgtcctaaactggaagctgggggaggatggagtgctggaatgctgcagaagtctcatgggagggcgcctggtgttcaccacatgtgtacactgttgcacgaccaggaaccttcagaaagggcagaaaggaagtttacttctgcctctacaatggatttgcctactttagacatgttttcaagatttatccacgtcatggcatataccagaacttcatttcttttatgattgaataatattacatggttttaatatactatattttgtttatctgttcatcaattaataaatctttgggttgttttcacttttaggctataataattaacgctgttaggaatatttacttgtaagtttttgttatatgtttttaattctcctgggtagatacttagggataaaattgctgaattagattgtaactttatgtttagaaactgcccaactgttttccaaagtaactatcattttaatatttcaccagcattgtatgacagttctggtctttccttatttaaactaatacttaattattgccttttattgtagctatcctagtagatatgaagtgttatctcattatggttttgatttgcattctctaatgactaataatatcaagcatcttttcatgtgtatacaagatatttgtatatcttctttagagaaatgtctactcaaatcctgtgcctatgttttaattggataatttatgtttttattgttgagttgtaatagtttttaaatatattctggatcctagacctttaaca

SEQ ID NO: 419665 - DNA, 1053 bp, Homo sapiens
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactggtattctccactggttgaatgcaaatggaagccagaggaaaagggaacccttgacacagttttcatatagattggcctccagggcagacagcaggagtggggtttaatctggactgaattggaggaaaggaactggcaccagagtggaggctggaaggatggtggaactgacactgggacagaacacagaaaacagaatctaatgctattgctctggctatatcaaataaaagtgtcaagagtgagcatccttgccttgtgctgaatcacaaaggaatacctttcagtttttctccattgattatgatagcagtgggcttttcacagtgggctttactgtgttgaggtaccctaatgacaagttcaccccagtgttttctgaggagtctacctggaaatgagaaccatctgtccttcctatagtagttcttctcagaatgccgactctatgctaatggctacccacagatccagggccataaataactgccaaagaagagaagccttctctcttctctgctgttgcttcattttatagtctcaggaaatctcatcatagaagtgcctttcaccttctgccatgattgtgaggcttcgctagctacgtggaact

SEQ ID NO: 419666 - DNA, 1625 bp, Homo sapiens
  misc_feature (1591)..(1591): n is a, c, g, or t
  misc_feature (1600)..(1600): n is a, c, g, or t
  misc_feature (1609)..(1609): n is a, c, g, or t
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactggtgctgctgtgacgaccagctttgtgtggcctccagtggacttcatatggacatagccgaccatgccttgccttgtcagtcccacatccctcaccttcggacctgggcttccctgttgatacagaggcactggatatcttgagacttgctcaccatgacttgctctggctatatcaaataaaagtgtcaagagtgagcatccttgccttgtgctgaatcacaaaggaatacctttcagtttttctccattgattatgatagcagtgggcttttcacagtgggctttactgtgttgaggtatgctattaatgtgccctgtgactgggtccatgccccagtcctattttcctggctttatggaagatgccacaacatcagctgagctgatataagaatttcctaactcatgaggaggtctgatggccgggaggacaggaagaaggaacccacaatgaagcaaaagttgcgtttaactctgtcctcaccattcctctcctggacctgtcctaaactggaagctgggggaggatggagtgctggaatgctgcagaagtctcatgggagggcgcctggtgttcaccacatgtgtacactgttgcacgaccaggttggcactttgcatgtgggaaacgatcagagaatggtgggggatgcttaagaggcatcactggaatcctacggtaccacagaccagagccttcccttcccttcctctcccacagatggaaatttgaatgctggggctcagtggaacacctgaaggaagctggtgaggcagatgtcccgctatgccttccaagtgtcatgcaaccagttcatgcctgtcagcatctctgccggtggactctgtgagtcagcaaatctacagagcagagagccacaagtggggacagatgtggtcaaatgccatttaaatcagtgattctcaacccaggagttgtcatggcactggccttgagtgagctggaccaagggaagtggtagaattccccatgaaggaccaagtgagcagatagaagtttctccattttaactttttctgagtcaatttaaaaaacacctagtgcctttttctgtacatagtgcctgtgggtttaatttaagcctacccaaatgtgcttttatcccacctattttgaaccttgcatgtntccgggatnagaattaanataagctataaatatt

SEQ ID NO: 419667 - DNA, 1449 bp, Homo sapiens
  misc_feature (1415)..(1415): n is a, c, g, or t
  misc_feature (1424)..(1424): n is a, c, g, or t
  misc_feature (1433)..(1433): n is a, c, g, or t
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactggtattctccactggttgaatgcaaatggaagccagaggaaaagggaacccttgacacagttttcatatagattggcctccagggcagacagcagttgctctggctatatcaaataaaagtgtcaagagtgagcatccttgccttgtgctgaatcacaaaggaatacctttcagtttttctccattgattatgatagcagtgggcttttcacagtgggctttactgtgttgaggaggaggtctgatggccgggaggacaggaagaaggaacccacaatgaagcaaaagttgcgtttaactctgtcctcaccattcctctcctggacctgtcctaaactggaagctgggggaggatggagtgctggaatgctgcagaagtctcatgggagggcgcctggtgttcaccacatgtgtacactgttgcacgaccaggttggcactttgcatgtgggaaacgatcagagaatggtgggggatgcttaagaggcatcactggaatcctacggtaccacagaccagagccttcccttcccttcctctcccacagatggaaatttgaatgctggggctcagtggaacacctgaaggaagctggtgaggcagatgtcccgctatgccttccaagtgtcatgcaaccagttcatgcctgtcagcatctctgccggtggactctgtgagtcagcaaatctacagagcagagagccacaagtggggacagatgtggtcaaatgccatttaaatcagtgattctcaacccaggagttgtcatggcactggccttgagtgagctggaccaagggaagtggtagaattccccatgaaggaccaagtgagcagatagaagtttctccattttaactttttctgagtcaatttaaaaaacacctagtgcctttttctgtacatagtgcctgtgggtttaatttaagcctacccaaatgtgcttttatcccacctattttgaaccttgcatgtntccgggatnagaattaanataagctataaatatt

SEQ ID NO: 419668 - DNA, 594 bp, Homo sapiens
gtttctcccatttagaatatctagcatgtaaggcctttcaatattaatataagcccaatatcagctctttctctttgtatttcatctctttctactctcctatttgtattttgtgttcctatcaaagtgtcgtatctgggagatgacctgccttatcctgttctataacagttttgtttgctgctgtgtctttagaacagtgcctggcacacagtaagcactcaataaatctttgatgaatgaatgaatggttatcttttctctctggcaatccaaattcaccactccttaaaaattctacataagatttgctggctgggcgcagtgactcacgcctgtaatcccagcactttgggagactgagacaggtggatcacctgaggtcaggagtttgagaccagtctcaacatagcgaaaccccatctctactaaaagtacaaaaattagccgggcgtggtggcaggcgcctgtaatcccagctacttgggagactgaggcaggagaatcacttgagcccaggggggcagaggttgcagtgagctgagatcacgccacttcactccagcctgggcaaaagagcaaaactccgtctcc

SEQ ID NO: 419669 - DNA, 1492 bp, Homo sapiens
atggcgggcgcccctcccccagcctcgctgccgccttgcagtttgatctcggactgctgtgctagcaatcagcgagactccgtgggcgtagcaccctccgagccaggtgcgggatataatctggtggtgcaccgttttttaagctggtccgaaaagcgcagtattcgggtgggagtgacccgattttccaggtgctgcgttgccatctttaaagtcatcacactggaccacatcagtattgcaagctgcttgggtatcattaatgaagacaaagtgggattattattttctatgatttgggcttttgtattctccactggttgaatgcaaatggaagccagaggaaaagggaacccttgacacagttttcatatagattggcctccagggcagacagcaggagtggggtttaatctggactgaattggaggaaaggaactggcaccagagtggaggctggaaggatggtggaactgacactgggacagaacacagaaaacagaatctaatgctagtaccctaatgacaagttcaccccagtgttttctgaggagtctacctggaaatgagaaccatctgtccttcctatagtagttcttctcagaatgccgactctatgctaatggaggaggtctgatggccgggaggacaggaagaaggaacccacaatgaagcaaaagttgcgtttaactctgtcctcaccattcctctcctggacctgtcctaaactggaagctgggggaggatggagtgctggaatgctgcagaagtctcatgggagggcgcctggtgttcaccacatgtgtacactgttgcacgaccaggaaccttcagaaagggcagaaaggaagtttacttctgcctctacaatggatttgcctactttagacatgttttcaagatttatccacgtcatggcatataccagaacttcatttcttttatgattgaataatattacatggttttaatatactatattttgtttatctgttcatcaattaataaatctttgggttgttttcacttttaggctataataattaacgctgttaggaatatttacttgtaagtttttgttatatgtttttaattctcctgggtagatacttagggataaaattgctgaattagattgtaactttatgtttagaaactgcccaactgttttccaaagtaactatcattttaatatttcaccagcattgtatgacagttctggtctttccttatttaaactaatacttaattattgccttttattgtagctatcctagtagatatgaagtgttatctcattatggttttgatttgcattctctaatgactaataatatcaagcatcttttcatgtgtatacaagatatttgtatatcttctttagagaaatgtctactcaaatcctgtgcctatgttttaattggataatttatgtttttattgttgagttgtaatagtttttaaatatattctggatcctagacctttaaca

SEQ ID NO: 419670 - DNA, 818 bp, Homo sapiens
atggcgggcgcccctcccccagcctcgctgccgccttgcagtttgatctcggactgctgtgctagcaatcagcgagactccgtgggcgtagcaccctccgagccaggtgcgggatataatctggtggtgcaccgttttttaagctggtccgaaaagcgcagtattcgggtgggagtgacccgattttccaggtattctccactggttgaatgcaaatggaagccagaggaaaagggaacccttgacacagttttcatatagattggcctccagggcagacagcagttgctctggctatatcaaataaaagtgtcaagagtgagcatccttgccttgtgctgaatcacaaaggaatacctttcagtttttctccattgattatgatagcagtgggcttttcacagtgggctttactgtgttgaggtaccctaatgacaagttcaccccagtgttttctgaggagtctacctggaaatgagaaccatctgtccttcctatagtagttcttctcagaatgccgactctatgctaatggaaagaagtgagatgatgatggctctgtctcagcagctctcggggggacctgcaggctggggaggcagcttctctctgcaatttggccgctcctggacttgttgcagccaggcttcaaagagaaaccaccgcttcctccccgagccccacgccagcctcagaggcagctgggcctattgaaacattcaagtttcacttcaggctactttaaacatttgctttattccaaaacagctaaacttggagttattttcaaatataggccatttttatgccccagtata

SEQ ID NO: 419671 - DNA, 1304 bp, Homo sapiens
  misc_feature (990)..(990): n is a, c, g, or t
  misc_feature (1003)..(1003): n is a, c, g, or t
  misc_feature (1091)..(1091): n is a, c, g, or t
gcacatgcgcagaatcatcgtggtgcagggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagtgattctaccagaaaggaatgaagaacagaaccttcaggaattgagtcacaatgcagacaaatatcaaatgggagattgttgcaaggaagagattgatgatagtattttctactagccattgggaagataaaaggagacagaagattgaagcctttgccagccattctttccctttttgcttccaaactcctcaactgggaaccttcatatgtgcagtatttatattggatcatactggtgattataaaagttcctaggaggctagaagagccaaccaacagagaagggaaagcagtctgttctgaacatagggacataagttcattcatgccaagtatctttccagcatgtttctcccatttagaatatctagcatgtaaggcctttcaatattaatataagcccaatatcagctctttctctttgtatttcatctctttctactctcctatttgtattttgtgttcctatcaaagtgtcgtatctgggagatgacctgccttatcctgttctataacagttttgtttgctgctgtgtctttagaacagtgcctggcacacagtaagcactcaataaatctttgatgaatgaaaaaccaaanaaaaatgtgcctnggttggcctaagcgttggaacttttgcggccgtttccctttaggaaggggaattcatgaaccccgctactgactccgtgggttgggcnttcggttgcggaagcggatcagcctcctaagggcggaatccggttttccacaatcagggataccccagaaaaactgggaccaaaggccgcaaaggccgaacccgaaaggccggttggtgcgttttcctagctccccccccgaaggctaccaaatcaccttaatcaaaggggcaacccgaaggctttaaaatccggcgtcccctgagcttctcg

SEQ ID NO: 419672 - DNA, 376 bp, Homo sapiens
gccaggcctgcaacttaaagatgctcccggggaggcgaccagagatgtcccttcctgaccccgcttccctactccagccctgacaacaggtcatctcttggccccgaaaatctgtcacctgcaccctggagcctgggtgactttgaacagctggtgaccagtctgacccttcacgatcctaacatctttggtccccagtaaaggcgctgaagcactgcatgatgttgctgagaacttggggactcggttctgtgagggggaaaagaggttgaaaagagggtttcctcttatttcttccctgtgcgtaaacataagacaatccctcttcagaataaacttgctttataatcaaaaaaaaactgtgcctttgaatcta

SEQ ID NO: 419673 - DNA, 1886 bp, Homo sapiens
cccaatatatatcaggtctgttatgctctaaacaccgtgccgggtgctgaggatcaaagatgaatagagaaatgaactgaaatgatatagtgaagttaaaacttaaagaacacaacaaatctgtaaaagacaaacaaaagagggtttaatctgtgcttctgtccaggtgtgtggagctgggggtggggttgcacctgcccgggagcattcccaaggcaaatatttgagaggaattagatttctaatacccaggttggctctcactttcaggaagatgtgagacctgaatcctaacctggacgcattgttcccctaattcccagcagcagatctatgaattagcggtctgggtggcagcccattcttctttcagaggcccagaacaccgtgaaactatgctttcctgactcaagagaccctacctagacgtgggcccctttgacgagcacctgcccctcaggagggtctcaggcgaccttcttggaaggtgtgaccacttgaaaaggacgaggaggccaggcgctgtggctctcgcctgtaattccagcacttagggagccgaggcgggaggatcgcttgagtccaggagtttgaggccagcctgggcaagattgggagacactccccaccccgccccatttctacaagtaattaaaaatttagccgggcgtggtggcgggagcaggagccactcaagaggctgaggcaggagtatcacttgagtcctggaggtggagactgcagtgagcggtgatcgcgccactgcattacagcctgggcgacacagcgagacctgtcaatcaatcaatcaatcaatcaatcaagaggaggctggcgggagcatgctcgtgaccaccgggggcgacatagacccttaaccctaagtccaaccccaaggcagaccccaccgtcccgccaggcgcactcctaagagcgcggcttccggagcaaagccgctgacccccgcccccagggtcttggcgccgattggccaacgagagcgcagggcggagccaaatcttaaaggatccgggagctaagccagacccgggtggcggtggcagctgcgaaacccagggagccgatgccacgtgacccaatgtggacttcttttaaacctttctaatgcccataacccagcctcagacccatggagcccacgagagactgcccgctgttcgggggcgccttttccgccatcctccccatgggggccattgacgtaagcgacctccgaccggtcccggacaatcaagaagttttctgccatcccgtgacggaccagagcctgatagtggaacttctcgagctgcaggcccacgtacggggcgaagcggctgcgcggtaccactttgaggatgttggtggcgtgcagggggctagggctgtccatgtggagtctgttcagcctctcagtttggagaacctggccctgaggggccgctgtcaagaagcctgggtcctctctggcaagcagcagatagctaaggaaaaccagcaggtagcaaaggacgtgacacttcatcaggccttgctgaggctgccccagtaccagactgatctcttgcttaccttcaatcagcccccccctgacaacaggtcatctcttggccccgaaaatctgtcacctgcaccctggagcctgggtgactttgaacagctggtgaccagtctgacccttcacgatcctaacatctttggtccccagtaaaggcgctgaagcactgcatgatgttgctgagaacttggggactcggttctgtgagggggaaaagaggttgaaaagagggtttcctcttatttcttccctgtgcgtaaacataagacaatccctcttcagaataaacttgctttataatcaaaaaaaaactgtgcctttgaatcta

SEQ ID NO: 419674 - DNA, 2118 bp, Homo sapiens
cccaatatatatcaggtctgttatgctctaaacaccgtgccgggtgctgaggatcaaagatgaatagagaaatgaactgaaatgatatagtgaagttaaaacttaaagaacacaacaaatctgtaaaagacaaacaaaagagggtttaatctgtgcttctgtccaggtgtgtggagctgggggtggggttgcacctgcccgggagcattcccaaggcaaatatttgagaggaattagatttctaatacccaggttggctctcactttcaggaagatgtgagacctgaatcctaacctggacgcattgttcccctaattcccagcagcagatctatgaattagcggtctgggtggcagcccattcttctttcagaggcccagaacaccgtgaaactatgctttcctgactcaagagaccctacctagacgtgggcccctttgacgagcacctgcccctcaggagggtctcaggcgaccttcttggaaggtgtgaccacttgaaaaggacgaggaggccaggcgctgtggctctcgcctgtaattccagcacttagggagccgaggcgggaggatcgcttgagtccaggagtttgaggccagcctgggcaagattgggagacactccccaccccgccccatttctacaagtaattaaaaatttagccgggcgtggtggcgggagcaggagccactcaagaggctgaggcaggagtatcacttgagtcctggaggtggagactgcagtgagcggtgatcgcgccactgcattacagcctgggcgacacagcgagacctgtcaatcaatcaatcaatcaatcaatcaagaggaggctggcgggagcatgctcgtgaccaccgggggcgacatagacccttaaccctaagtccaaccccaaggcagaccccaccgtcccgccaggcgcactcctaagagcgcggcttccggagcaaagccgctgacccccgcccccagggtcttggcgccgattggccaacgagagcgcagggcggagccaaatcttaaaggatccgggagctaagccagacccgggtggcggtggcagctgcgaaacccagggagccgatgccacgtgacccaatgtggacttcttttaaacctttctaatgcccataacccagcctcagacccatggagcccacgagagactgcccgctgttcgggggcgccttttccgccatcctccccatgggggccattgacgtaagcgacctccgaccggtcccggacaatcaagaagttttctgccatcccgtgacggaccagagcctgatagtggaacttctcgagctgcaggcccacgtacggggcgaagcggctgcgcggtaccactttgaggatgttggtggcgtgcagggggctagggctgtccatgtggagtctgttcagcctctcagtttggagaacctggccctgaggggccgctgtcaagaagcctgggtcctctctggcaagcagcagatagctaaggaaaaccagcaggtagcaaaggacgtgacacttcatcaggccttgctgaggctgccccagtaccagactgatctcttgcttaccttcaatcagccccccagcccccgtaaggaggaaggaacgggcgggtatctcatgactgggttcccaggagaatcgggctgggagggacagaacagggagactcactggtgggatcctccaaggaagcaggagtgggccagaggtttggggtaactgatacccaggtcctctggggaacaggaattggcaatttccaaacctcaggcctggatgatgttctgtctccatctgttcccccaccccaagccctgacaacaggtcatctcttggccccgaaaatctgtcacctgcaccctggagcctgggtgactttgaacagctggtgaccagtctgacccttcacgatcctaacatctttggtccccagtaaaggcgctgaagcactgcatgatgttgctgagaacttggggactcggttctgtgagggggaaaagaggttgaaaagagggtttcctcttatttcttccctgtgcgtaaacataagacaatccctcttcagaataaacttgctttataatcaaaaaaaaactgtgcctttgaatcta

SEQ ID NO: 419675 - DNA, 1452 bp, Homo sapiens
cccaatatatatcaggtctgttatgctctaaacaccgtgccgggtgctgaggatcaaagatgaatagagaaatgaactgaaatgatatagtgaagttaaaacttaaagaacacaacaaatctgtaaaagacaaacaaaagagggtttaatctgtgcttctgtccaggtgtgtggagctgggggtggggttgcacctgcccgggagcattcccaaggcaaatatttgagaggaattagatttctaatacccaggttggctctcactttcaggaagatgtgagacctgaatcctaacctggacgcattgttcccctaattcccagcagcagatctatgaattagcggtctgggtggcagcccattcttctttcagaggcccagaacaccgtgaaactatgctttcctgactcaagagaccctacctagacgtgggcccctttgacgagcacctgcccctcaggagggtctcaggcgaccttcttggaaggtgtgaccacttgaaaaggacgaggaggccaggcgctgtggctctcgcctgtaattccagcacttagggagccgaggcgggaggatcgcttgagtccaggagtttgaggccagcctgggcaagattgggagacactccccaccccgccccatttctacaagtaattaaaaatttagccgggcgtggtggcgggagcaggagccactcaagaggctgaggcaggagtatcacttgagtcctggaggtggagactgcagtgagcggtgatcgcgccactgcattacagcctgggcgacacagcgagaccgacctccgaccggtcccggacaatcaagaagttttctgccatcccgtgacggaccagagcctgatagtggaacttctcgagctgcaggcccacgtacggggcgaagcggctgcgcggtaccactttgaggatgttggtggcgtgcagggggctagggctgtccatgtggagtctgttcagcctctcagtttggagaacctggccctgaggggccgctgtcaagaagcctgggtcctctctggcaagcagcagatagctaaggaaaaccagcaggtagcaaaggacgtgacacttcatcaggccttgctgaggctgccccagtaccagactgatctcttgcttaccttcaatcagcccccccctgacaacaggtcatctcttggccccgaaaatctgtcacctgcaccctggagcctgggtgactttgaacagctggtgaccagtctgacccttcacgatcctaacatctttggtccccagtaaaggcgctgaagcactgcatgatgttgctgagaacttggggactcggttctgtgagggggaaaagaggttgaaaagagggtttcctcttatttcttccctgtgcgtaaacataagacaatccctcttcagaataaacttgctttataatcaaaaaaaaactgtgcctttgaatcta

SEQ ID NO: 419676 - DNA, 1860 bp, Homo sapiens
cccaatatatatcaggtctgttatgctctaaacaccgtgccgggtgctgaggatcaaagatgaatagagaaatgaactgaaatgatatagtgaagttaaaacttaaagaacacaacaaatctgtaaaagacaaacaaaagagggtttaatctgtgcttctgtccaggtgtgtggagctgggggtggggttgcacctgcccgggagcattcccaaggcaaatatttgagaggaattagatttctaatacccaggttggctctcactttcaggaagatgtgagacctgaatcctaacctggacgcattgttcccctaattcccagcagcagatctatgaattagcggtctgggtggcagcccattcttctttcagaggcccagaacaccgtgaaactatgctttcctgactcaagagaccctacctagacgtgggcccctttgacgagcacctgcccctcaggagggtctcaggcgaccttcttggaaggtgtgaccacttgaaaaggacgaggaggccaggcgctgtggctctcgcctgtaattccagcacttagggagccgaggcgggaggatcgcttgagtccaggagtttgaggccagcctgggcaagattgggagacactccccaccccgccccatttctacaagtaattaaaaatttagccgggcgtggtggcgggagcaggagccactcaagaggctgaggcaggagtatcacttgagtcctggaggtggagactgcagtgagcggtgatcgcgccactgcattacagcctgggcgacacagcgagacctgtcaatcaatcaatcaatcaatcaatcaagaggaggctggcgggagcatgctcgtgaccaccgggggcgacatagacccttaaccctaagtccaaccccaaggcagaccccaccgtcccgccaggcgcactcctaagagcgcggcttccggagcaaagccgctgacccccgcccccagggtcttggcgccgattggccaacgagagcgcagggcggagccaaatcttaaaggatccgggagctaagccagacccgggtggcggtggcagctgcgaaacccagggagccgatgccacgtgacccaatgtggacttcttttaaacctttctaatgcccataacccagcctcagacccatggagcccacgagagactgcccgctgttcgggggcgccttttccgccatcctccccatgggggccattgacgtaagcgacctccgaccggtcccggacaatcaagaagttttctgccatcccgtgacggaccagagcctgatagtggaacttctcgagctgcaggcccacgtacggggcgaagcggctgcgcggtaccactttgaggatgttggtggcgtgcagggggctagggctgtccatgtggagtctgttcagcctctcagtttggagaacctggccctgaggggccgctgtcaagaagcctgggtcctctctggcaagcagcagatagctaaggaaaaccagcaggtgagggcccgagagtgtgtaatgtcctggaagggcggtagcggggacgcagagatccagccctgacaacaggtcatctcttggccccgaaaatctgtcacctgcaccctggagcctgggtgactttgaacagctggtgaccagtctgacccttcacgatcctaacatctttggtccccagtaaaggcgctgaagcactgcatgatgttgctgagaacttggggactcggttctgtgagggggaaaagaggttgaaaagagggtttcctcttatttcttccctgtgcgtaaacataagacaatccctcttcagaataaacttgctttataatcaaaaaaaaactgtgcctttgaatcta

SEQ ID NO: 419677 - DNA, 1114 bp, Homo sapiens
cccaatatatatcaggtctgttatgctctaaacaccgtgccgggtgctgaggatcaaagatgaatagagaaatgaactgaaatgatatagtgaagttaaaacttaaagaacacaacaaatctgtaaaagacaaacaaaagagggtttaatctgtgcttctgtccaggtgtgtggagctgggggtggggttgcacctgcccgggagcattcccaaggcaaatatttgagaggaattagatttctaatacccaggttggctctcactttcaggaagatgtgagacctgaatcctaacctggacgcattgttcccctaattcccagcagcagatctatgaattagcggtctgggtggcagcccattcttctttcagaggcccagaacaccgtgaaactatgctttcctgactcaagagaccctacctagacgtgggcccctttgacgagcacctgcccctcaggagggtctcaggcgaccttcttggaaggtgtgaccacttgaaaaggacgaggaggccaggcgctgtggctctcgcctgtaattccagcacttagggagccgaggcgggaggatcgcttgagtccaggagtttgaggccagcctgggcaagattgggagacactccccaccccgccccatttctacaagtaattaaaaatttagccgggcgtggtggcgggagcaggagccactcaagaggctgaggcaggagtatcacttgagtcctggaggtggagactgcagtgagcggtgatcgcgccactgcattacagcctgggcgacacagcgagaccagcccccgtaaggaggaaggaacgggcgggtatctcatgactgggttcccaggagaatcgggctgcaccctggagcctgggtgactttgaacagctggtgaccagtctgacccttcacgatcctaacatctttggtccccagtaaaggcgctgaagcactgcatgatgttgctgagaacttggggactcggttctgtgagggggaaaagaggttgaaaagagggtttcctcttatttcttccctgtgcgtaaacataagacaatccctcttcagaataaacttgctttataatcaaaaaaaaactgtgcctttgaatcta

SEQ ID NO: 419678 - DNA, 2206 bp, Homo sapiens
cccaatatatatcaggtctgttatgctctaaacaccgtgccgggtgctgaggatcaaagatgaatagagaaatgaactgaaatgatatagtgaagttaaaacttaaagaacacaacaaatctgtaaaagacaaacaaaagagggtttaatctgtgcttctgtccaggtgtgtggagctgggggtggggttgcacctgcccgggagcattcccaaggcaaatatttgagaggaattagatttctaatacccaggttggctctcactttcaggaagatgtgagacctgaatcctaacctggacgcattgttcccctaattcccagcagcagatctatgaattagcggtctgggtggcagcccattcttctttcagaggcccagaacaccgtgaaactatgctttcctgactcaagagaccctacctagacgtgggcccctttgacgagcacctgcccctcaggagggtctcaggcgaccttcttggaaggtgtgaccacttgaaaaggacgaggaggccaggcgctgtggctctcgcctgtaattccagcacttagggagccgaggcgggaggatcgcttgagtccaggagtttgaggccagcctgggcaagattgggagacactccccaccccgccccatttctacaagtaattaaaaatttagccgggcgtggtggcgggagcaggagccactcaagaggctgaggcaggagtatcacttgagtcctggaggtggagactgcagtgagcggtgatcgcgccactgcattacagcctgggcgacacagcgagacctgtcaatcaatcaatcaatcaatcaatcaagaggaggctggcgggagcatgctcgtgaccaccgggggcgacatagacccttaaccctaagtccaaccccaaggcagaccccaccgtcccgccaggcgcactcctaagagcgcggcttccggagcaaagccgctgacccccgcccccagggtcttggcgccgattggccaacgagagcgcagggcggagccaaatcttaaaggatccgggagctaagccagacccgggtggcggtggcagctgcgaaacccagggagccgatgccacgtgacccaatgtggacttcttttaaacctttctaatgcccataacccagcctcagacccatggagcccacgagagactgcccgctgttcgggggcgccttttccgccatcctccccatgggggccattgacgtaagcgacctccgaccggtcccggacaatcaagaagttttctgccatcccgtgacggaccagagcctgatagtggaacttctcgagctgcaggcccacgtacggggcgaagcggctgcgcggtaccactttgaggatgttggtggcgtgcagggggctagggctgtccatgtggagtctgttcagcctctcagtttggagaacctggccctgaggggccgctgtcaagaagcctgggtcctctctggcaagcagcagatagctaaggaaaaccagcaggtgagggcccgagagtgtgtaatgtcctggaagggcggtagcggggacgcagagatccaggtaagcatcctgactctgatccccttaggtagcaaaggacgtgacacttcatcaggccttgctgaggctgccccagtaccagactgatctcttgcttaccttcaatcagccccccagcccccgtaaggaggaaggaacgggcgggtatctcatgactgggttcccaggagaatcgggctgggagggacagaacagggagactcactggtgggatcctccaaggaagcaggagtgggccagaggtttggggtaactgatacccaggtcctctggggaacaggaattggcaatttccaaacctcaggcctggatgatgttctgtctccatctgttcccccaccccaagccctgacaacaggtcatctcttggccccgaaaatctgtcacctgcaccctggagcctgggtgactttgaacagctggtgaccagtctgacccttcacgatcctaacatctttggtccccagtaaaggcgctgaagcactgcatgatgttgctgagaacttggggactcggttctgtgagggggaaaagaggttgaaaagagggtttcctcttatttcttccctgtgcgtaaacataagacaatccctcttcagaataaacttgctttataatcaaaaaaaaactgtgcctttgaatcta

SEQ ID NO: 419679 - DNA, 1800 bp, Homo sapiens
cccaatatatatcaggtctgttatgctctaaacaccgtgccgggtgctgaggatcaaagatgaatagagaaatgaactgaaatgatatagtgaagttaaaacttaaagaacacaacaaatctgtaaaagacaaacaaaagagggtttaatctgtgcttctgtccaggtgtgtggagctgggggtggggttgcacctgcccgggagcattcccaaggcaaatatttgagaggaattagatttctaatacccaggttggctctcactttcaggaagatgtgagacctgaatcctaacctggacgcattgttcccctaattcccagcagcagatctatgaattagcggtctgggtggcagcccattcttctttcagaggcccagaacaccgtgaaactatgctttcctgactcaagagaccctacctagacgtgggcccctttgacgagcacctgcccctcaggagggtctcaggcgaccttcttggaaggtgtgaccacttgaaaaggacgaggaggccaggcgctgtggctctcgcctgtaattccagcacttagggagccgaggcgggaggatcgcttgagtccaggagtttgaggccagcctgggcaagattgggagacactccccaccccgccccatttctacaagtaattaaaaatttagccgggcgtggtggcgggagcaggagccactcaagaggctgaggcaggagtatcacttgagtcctggaggtggagactgcagtgagcggtgatcgcgccactgcattacagcctgggcgacacagcgagacctgtcaatcaatcaatcaatcaatcaatcaagaggaggctggcgggagcatgctcgtgaccaccgggggcgacatagacccttaaccctaagtccaaccccaaggcagaccccaccgtcccgccaggcgcactcctaagagcgcggcttccggagcaaagccgctgacccccgcccccagggtcttggcgccgattggccaacgagagcgcagggcggagccaaatcttaaaggatccgggagctaagccagacccgggtggcggtggcagctgcgaaacccagggagccgatgccacgtgacccaatgtggacttcttttaaacctttctaatgcccataacccagcctcagacccatggagcccacgagagactgcccgctgttcgggggcgccttttccgccatcctccccatgggggccattgacgtaagcgacctccgaccggtcccggacaatcaagaagttttctgccatcccgtgacggaccagagcctgatagtggaacttctcgagctgcaggcccacgtacggggcgaagcggctgcgcggtaccactttgaggatgttggtggcgtgcagggggctagggctgtccatgtggagtctgttcagcctctcagtttggagaacctggccctgaggggccgctgtcaagaagcctgggtcctctctggcaagcagcagatagctaaggaaaaccagcagccctgacaacaggtcatctcttggccccgaaaatctgtcacctgcaccctggagcctgggtgactttgaacagctggtgaccagtctgacccttcacgatcctaacatctttggtccccagtaaaggcgctgaagcactgcatgatgttgctgagaacttggggactcggttctgtgagggggaaaagaggttgaaaagagggtttcctcttatttcttccctgtgcgtaaacataagacaatccctcttcagaataaacttgctttataatcaaaaaaaaactgtgcctttgaatcta

SEQ ID NO: 419680 - DNA, 1438 bp, Homo sapiens
cctcggccagcactcgtagcgcgctgggcgagccggaccggaagttgaagaagtgaagcgccgcgcgcgccgcctgctgcaggagcctgcgcgggaccccagcatcctgaggctgcccagggtcgtcggggtccccggaccccgcgggcgccgccaccggggcgagcaacagcagcagcgcgagcagcggggcggtggggcgcgggcccctgggcccggaccagggagcaggcagccgttgccggcggggctgcatggacgcaggaaagttggctcggcacccgacagacacgggctcggagcgggcagtgccggcgctcgcggaaataaggccgtgataattgtgaaacacctgtgccaggccctgggggaatgagggtgaacaatcttaaacatctctgccttcctggagcacaccttctagattcttcttccttgccacatactgtgtgggggagtgacattgctaactgtccaccacgttctccaaaagacctgtcatcatatcccacccctggcccagggctgctggaagactgtgccacataggaggtgaggaaagtatcagccagcaggttctgccccagcctctgcacagaagcagatgtgtccccacaagggtgtcctgatatgtcatgttccctagttccttagtcattgctcaggttatcatgagcattttagagaacttactttgtgtttaagaaacctaatggtatataaagctataatgacttttaatcatatgaaaagatagtacagacggtgagaggggaaactgacatgacctgtttgggtggacaatttgcaatatctattgaaattagaaatgcacatggctctgacccagcaattccaccttgagagtttataataacaatacattcacacatgtacataaagaagtatgtgcaaggatgttcatttccacatatggattgtaaactcctccacggcagtgacactgaatgtctcattttctactctctattccctagaacagtgactggcacacaatagacacgaatacagatttttttttttaaacaatgaagagttaagggctgggaaaacacctgtgtttcatggttgactaattatagtacctccatagaatggaatattgcacagtcatgaagaagaggtagattgaggtgtgtgtgatactgaaccatctctaaggtataatgttgttaacagcacggtgtagagtagggcaagtagtatgctgctatttgtttaaaaagaaaaaaataacatacataaatgtggaaatatgcaaaaactgtctctgcaaaggtttataagaattgccattataggatgagagagaaactcttcaccattggctctcttttgtggtggttgcttttttcatgtgtgtataatgtatatggtctattctaaataagtaaataaatgaggtgctgtttccgaa

SEQ ID NO: 419681 - DNA, 523 bp, Homo sapiens
cctcggccagcactcgtagcgcgctgggcgagccggaccggaagttgaagaagtgaagcgccgcgcgcgccgcctgctgcaggagcctgcgcgggaccccagcatcctgaggctgcccagggtcgtcggggtccccggaccccgcgggcgccgccaccggggcgagcaacagcagcagcgcgagcagcggggcggtggggcgcgggcccctgggcccggaccagggagcaggcagccgttgccggcggggctgcatggacgcaggaaagttggctcggcacccgacagacacgggctcggagcgggcagtgccggcgctcgcggaaataaggccgtggtgggcccctcccctccgcccccagggcgaagataattgtgaaacacctgtgccaggccctgggggaatgagggtgaacaatcttaaacatctctgccttcctggagcacaccttctaggaatcagcggatcctggagtttatttcttattatttcacttccctgaagctggagttgctgtttctt

SEQ ID NO: 419682 - DNA, 1500 bp, Homo sapiens
cctcggccagcactcgtagcgcgctgggcgagccggaccggaagttgaagaagtgaagcgccgcgcgcgccgcctgctgcaggagcctgcgcgggaccccagcatcctgaggctgcccagggtcgtcggggtccccggaccccgcgggcgccgccaccggggcgagcaacagcagcagcgcgagcagcggggcggtggggcgcgggcccctgggcccggaccagggagcaggcagccgttgccggcggggctgcatggacgcaggaaagttggctcggcacccgacagacacgggctcggagcgggcagtgccggcgctcgcggaaataaggccgtggtgggcccctcccctccgcccccagggcgaagataattgtgaaacacctgtgccaggccctgggggaatgagggtgaacaatcttaaacatctctgccttcctggagcacaccttctaggttgcacagtggctcagagagtagacttggagccaggctgcccggttttatagccctgcttgacctgtgtgatccgagaataatcttgtttaatctccacaagtttgaggactaaactgggtgccacagagaattaagtaactggtcgaggttgtatcagtaagaagggagcacggaacagattcaagctcagatggagtctcacactgtcacccgggctggaatgcagtggtgtgatcttggctcacctcccaggttcaagcgattctgctgcctctgcctcccgagcagctgggattccagggagcctggttggacttcaggcccctgtgaggctgactctgtagtcctggagaaactcaacagccaggaacttaggaccatttgtgtgtggcatttgggctaaccagactggtggcttctaaagaagatggaaagcatcacgtttcctgtatttaaattatttggtgatctcaatactggttgttagccaaagtacacaatggagacagcctatttgctctactacttttgatgtagaaatattactaagcttgagctgattaatagaactgttacacatttctgtgctccccttactggtggcatgaaataattcttttaaaacctgccatgtgttcacatttaaaactaaaagtaatttagattacatggatttgagaagcccatgttgacacgtaattgccaacagatgggctttcaaatgtaatgaagtgaaaatggtcagtaccccatgtgttggattttgcaattttccaaagtaagctgtcatttttggcatgtcatgctagttaagaacacaatgtatttatagctcaattatacattttctgatgaatttggcatggcattttgtttttccatcagtcacttaagacaggacatttgccattccaagaatgaattaacactcttctaagtgatctataaactgagatgtaaaataaattacaaattgggactgttttagtttttcaagcaaagggtgtttaaataaagcttgaaatcataaaccttaaaaac

SEQ ID NO: 419683 - DNA, 1390 bp, Homo sapiens
cctcggccagcactcgtagcgcgctgggcgagccggaccggaagttgaagaagtgaagcgccgcgcgcgccgcctgctgcaggagcctgcgcgggaccccagcatcctgaggctgcccagggtcgtcggggtccccggaccccgcgggcgccgccaccggggcgagcaacagcagcagcgcgagcagcggggcggtggggcgcgggcccctgggcccggaccagggagcaggcagccgttgccggcggggctgcatggacgcaggaaagttggctcggcacccgacagacacgggctcggagcgggcagtgccggcgctcgcggaaataaggccgtggtgggcccctcccctccgcccccagggcgaagataattgtgaaacacctgtgccaggccctgggggaatgagggtgaacaatcttaaacatctctgccttcctggagcacaccttctaggttgcacagtggctcagagagtagacttggagccaggctgcccggttttatagccctgcttgacctgtgtgatccgagaataatcttgtttaatctccacaagtttgaggactaaactgggtgccacagagaattaagtaactggtcgaggttgtatcagtaagaagggagcacggaacagattcaagctcagggagcctggttggacttcaggcccctgtgaggctgactctgtagtcctggagaaactcaacagccaggaacttaggaccatttgtgtgtggcatttgggctaaccagactggtggcttctaaagaagatggaaagcatcacgtttcctgtatttaaattatttggtgatctcaatactggttgttagccaaagtacacaatggagacagcctatttgctctactacttttgatgtagaaatattactaagcttgagctgattaatagaactgttacacatttctgtgctccccttactggtggcatgaaataattcttttaaaacctgccatgtgttcacatttaaaactaaaagtaatttagattacatggatttgagaagcccatgttgacacgtaattgccaacagatgggctttcaaatgtaatgaagtgaaaatggtcagtaccccatgtgttggattttgcaattttccaaagtaagctgtcatttttggcatgtcatgctagttaagaacacaatgtatttatagctcaattatacattttctgatgaatttggcatggcattttgtttttccatcagtcacttaagacaggacatttgccattccaagaatgaattaacactcttctaagtgatctataaactgagatgtaaaataaattacaaattgggactgttttagtttttcaagcaaagggtgtttaaataaagcttgaaatcataaaccttaaaaac

SEQ ID NO: 419684 - DNA, 882 bp, Homo sapiens
cctcggccagcactcgtagcgcgctgggcgagccggaccggaagttgaagaagtgaagcgccgcgcgcgccgcctgctgcaggagcctgcgcgggaccccagcatcctgaggctgcccagggtcgtcggggtccccggaccccgcgggcgccgccaccggggcgagcaacagcagcagcgcgagcagcggggcggtggggcgcgggcccctgggcccggaccagggagcaggcagccgttgccggcggggctgcatggacgcaggaaagttggctcggcacccgacagacacgggctcggagcgggcagtgccggcgctcgcggaaataaggccgtggtgggcccctcccctccgcccccagggcgaagataattgtgaaacacctgtgccaggccctgggggaatgagggtgaacaatcttaaacatctctgccttcctggagcacaccttctaggttgcacagtggctcagagagtagacttggagccaggctgcccggttttatagccctgcttgacctgtgtgatccgagaataatcttgtttaatctccacaagtttgaggactaaactgggtgccacagagaattaagtaactggtcgaggttgtatcagtaagaagggagcacggaacagattcaagctcaggctggagtgcaatggtgtgatctcacctcactgtaatctccattcccccgggttcaaaagattttcctgcctctacttgccaagaagctgggattccaggcatgcaccacgatgcctagctaatttttgtacttttagtagaaatgggttcttgccatgttgaccaggctggtcttgaactcctgacctccagtgatctgcttgccttggcctcccaaagtgctgggattaca

SEQ ID NO: 419685 - DNA, 946 bp, Homo sapiens
cctcggccagcactcgtagcgcgctgggcgagccggaccggaagttgaagaagtgaagcgccgcgcgcgccgcctgctgcaggagcctgcgcgggaccccagcatcctgaggctgcccagggtcgtcggggtccccggaccccgcgggcgccgccaccggggcgagcaacagcagcagcgcgagcagcggggcggtggggcgcgggcccctgggcccggaccagggagcaggcagccgttgccggcggggctgcatggacgcaggaaagttggctcggcacccgacagacacgggctcggagcgggcagtgccggcgctcgcggaaataaggccgtggtgggcccctcccctccgcccccagggcgaagataattgtgaaacacctgtgccaggccctgggggaatgagggtgaacaatcttaaacatctctgccttcctggagcacaccttctaggttgcacagtggctcagagagtagacttggagccaggctgcccggttttatagccctgcttgacctgtgtgatccgagaataatcttgtttaatctccacaagtttgaggactaaactgggtgccacagagaattaagtaactggtcgaggttgtatcagtaagaagggagcacggaacagattcaagctcagcttacacttggcaatcttctagggaggactttggctgaacccagtgaaccaggaggaaaagaatcacaaacatctggagtttgttgactagaaaaattccttgtggtctgacagattaccatttcctacccagccattctcatcagagaaaccagtcccattttcaactggcgcggctagttgaaagttccacatgtttccccagaaaatggcatagccagaaggccctcaccagattccagcaccagcctccagaacatgagccaaataaatcatcgtttataaattaaaaagtct

SEQ ID NO: 419686 - DNA, 758 bp, Homo sapiens
taagctgtattcattcagacgcaagcttatgtgacatgtagcagtctgacacttactgagccctaactctgtgctttaacagcagccttgtttaggtcatcactgttattagcatccccattttacagaggaagccaccaacacatgaatgtaaaaagatcttctgggctcccatggctcacgctctgtaatcatagtcatttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagacccccatccttgcacacctgactctgtcactcaagcctttctccaccaggcccctcatctgaataccaagcacagaaatgagtggtgtgactaattccttacctctcccaaggagggtacacaactagcaccattcttgatgtccagggaagaagccacctcaagacatatgaggggtgccctgggctaatgttagggcttaattttctcaaagcctgacctttcaaatccatgatgaatgccatcagtccctcctgctgttgcctccctgtgacctggaggacagtgtgtgccatgtctcccatactagagataaataaatgtagccacatttactgtgaaaaaaatataa

SEQ ID NO: 419687 - DNA, 2174 bp, Homo sapiens
cttggctgctttcatctctgaagcgccacttctcagaaacacagagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggtggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacagaactcgagaagtgcttctgccgaaattcaagctggagaagaactacaatctagtggagtccctgaagttgatggggatcaggatgctgtttgacaaaaatggcaacatggcaggcatctcagaccaaaggatcgccatcgacctgttcaagcaccaaggcacgatcacagtgaacgaggaaggcacccaagccaccactgtgaccacggtggggttcatgccgctgtccacccaagtccgcttcactgtcgaccgcccctttcttttcctcatctacgagcaccgcaccagctgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttgttggaatcaattctgcacaatagcccatgctgtaagctcatagaagtcactgtaactgtagtgtgtctgctgttacctagagggtctcacctccccactcttcacagcaaacctgagcagcgcgtcctaagcacctcccgctccggtgaccccatccttgcacacctgactctgtcactcaagcctttctccaccaggcccctcatctgaataccaagcacagaaatgagtggtgtgactaattccttacctctcccaaggagggtacacaactagcaccattcttgatgtccagggaagaagccacctcaagacatatgaggggtgccctgggctaatgttagggcttaattttctcaaagcctgacctttcaaatccatgatgaatgccatcagtccctcctgctgttgcctccctgtgacctggaggacagtgtgtgccatgtctcccatactagagataaataaatgtagccacatttactgtgaaaaaaatataa

SEQ ID NO: 419688 - DNA, 2180 bp, Homo sapiens
cttggctgctttcatctctgaagcgccacttctcagaaacacagagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacagaactcgagaagtgcttctgccgaaattcaagctggagaagaactacaatctagtggagtccctgaagttgatggggatcaggatgctgtttgacaaattcaagcaccaaggcacgatcacagtgaacgaggaaggcacccaagccaccactgtgaccacggtggggttcatgccgctgtccacccaagtccgcttcactgtcgaccgcccctttcttttcctcatctacgagcaccgcaccagctgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttgttggaatcaattctgcacaatagcccatgctgtaagctcatagaagtcactgtaactgtagtgtgtctgctgttacctagagggtctcacctccccactcttcacagcaaacctgagcagcgcgtcctaagcacctcccgctccggtgaccccatccttgcacacctgactctgtcactcaagcctttctccaccaggcccctcatctgaataccaagcacagaaatgagtggtgtgactaattccttacctctcccaaggagggtacacaactagcaccattcttgatgtccagggaagaagccacctcaagacatatgaggggtgccctgggctaatgttagggcttaattttctcaaagcctgacctttcaaatccatgatgaatgccatcagtccctcctgctgttgcctccctgtgacctggaggacagtgtgtgccatgtctcccatactagagataaataaatgtagccacatttactgtgaaaaaaatataa

SEQ ID NO: 419689 - DNA, 1259 bp, Homo sapiens
cttggctgctttcatctctgaagcgccacttctcagaaacacagagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagacccccatccttgcacacctgactctgtcactcaagcctttctccaccaggcccctcatctgaataccaagcacagaaatgagtggtgtgactaattccttacctctcccaaggagggtacacaactagcaccattcttgatgtccagggaagaagccacctcaagacatatgaggggtgccctgggctaatgttagggcttaattttctcaaagcctgacctttcaaatccatgatgaatgccatcagtccctcctgctgttgcctccctgtgacctggaggacagtgtgtgccatgtctcccatactagagataaataaatgtagccacatttactgtgaaaaaaatataa

SEQ ID NO: 419690 - DNA, 381 bp, Homo sapiens
tgacagatgtgacagatgaagaaatagaagcgagttaggtgccttaccatggtcaaacaactagttcgtatcagaccctactccagaaactattccagtccgggtaacctctcgttaacctctcttgttagaaatgcaaatttctgcccaaatcaggcctcaggaatcaagagactgtggggtcggctctgcaggctatctgaatgaggcctccagggaaatcagattcactctcaagggtgagacgatttccctaaaggaaccttctcataacagcctcttcctgtggcctttacaggatcctgggtgaataaattcccagtggaaatgacacacaaccacaacttccggctgaatgagagagaggtagttaaggtttcc

SEQ ID NO: 419691 - DNA, 2228 bp, Homo sapiens
cttggctgctttcatctctgaagcgccacttctcagaaacacagagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacagaactcgagaagtgcttctgccgaaattcaagctggagaagaactacaatctagtggagtccctgaagttgatggggatcaggatgctgtttgacaaaaatggcaacatggcaggcatctcagaccaaaggatcgccatcgacctgttcaagcaccaaggcacgatcacagtgaacgaggaaggcacccaagccaccactgtgaccacggtggggttcatgccgctgtccacccaagtccgcttcactgtcgaccgcccctttcttttcctcatctacgagcaccgcaccagctgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttgttggaatcaattctgcacaatagcccatgctgtaagctcatagaagtcactgtaactgtagtgtgtctgctgttacctagagggtctcacctccccactcttcacagcaaacctgagcagcgcgtcctaagcacctcccgctccggtgaccccatccttgcacacctgactctgtcactcaagcctttctccaccaggcccctcatctgaataccaagcacagaaatgagtggtgtgactaattccttacctctcccaaggagggtacacaactagcaccattcttgatgtccagggaagaagccacctcaagacatatgaggggtgccctgggctaatgttagggcttaattttctcaaagcctgacctttcaaatccatgatgaatgccatcagtccctcctgctgttgcctccctgtgacctggaggacagtgtgtgccatgtctcccatactagagataaataaatgtagccacatttactgtgaaaaaaatataa

SEQ ID NO: 419692 - DNA, 1776 bp, Homo sapiens
cttggctgctttcatctctgaagcgccacttctcagaaacacagagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggatcctgggtgaataaattcccagtggaaatgacacacaaccacaacttccggctgaatgagagagaggtagttaaggtttccatgatgcagaccaaggggaacttcctcgcactgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttgttggaatcaattctgcacaatagcccatgctgtaagctcatagaagtcactgtaactgtagtgtgtctgctgttacctagagggtctcacctccccactcttcacagcaaacctgagcagcgcgtcctaagcacctcccgctccggtgaccccatccttgcacacctgactctgtcactcaagcctttctccaccaggcccctcatctgaataccaagcacagaaatgagtggtgtgactaattccttacctctcccaaggagggtacacaactagcaccattcttgatgtccagggaagaagccacctcaagacatatgaggggtgccctgggctaatgttagggcttaattttctcaaagcctgacctttcaaatccatgatgaatgccatcagtccctcctgctgttgcctccctgtgacctggaggacagtgtgtgccatgtctcccatactagagataaataaatgtagccacatttactgtgaaaaaaatataa

SEQ ID NO: 419693 - DNA, 1718 bp, Homo sapiens
cttggctgctttcatctctgaagcgccacttctcagaaacacagagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacagaactcgagaagtgcttctgccgaaattcaagctggagaagaactacaatctagtggagtccctgaagttgatggggatcaggatgctgtttgacaaaaatggcaacatggcaggcatctcagaccaaaggatcgccatcgacctgttcaagcaccaaggcacgatcacagtgaacgaggaaggcacccaagccaccactgtgaccacggtggggttcatgccgctgtccacccaagtccgcttcactgtcgaccgcccctttcttttcctcatctacgagcaccgcaccagctgcctgctcttcatgggaagagtggccaaccccagcaggtcctagaggtggaggtctaggtgtctgaagtgccttgggggcaccctcatttggccatctctccaccacccggggtgtcagttgcgcttcgagggtcttcatcccagacatcttgtgtgtgaccacatattagcattacgatgcccgccacgtattcaccgg

SEQ ID NO: 419694 - DNA, 901 bp, Homo sapiens
ggattccgcttcggggcccgcgcgagttgggtgcttcggagggcgcgagaggagcgggcgggtgctgctgagtaatccccgcggcggcggccggacgcccacctcccacgccgcgccgcagccgggccgcggctcctccctccgcggtccttccctcctcttccctcccgtcttctcccctcccctcccctcccctcccggctccgcttggctccgggcaggtagagccgggctccgggcgcgcgcggggccgcagcagctgctcccgatctcgcctcggcccagcgcagggcctcgcacgcccatggccggctcggagcagcatgcggccgcggcggcgggacgacggagactcggacgcggcagcggcggcggcggcgcccctgcaggacgcggagctggccctggccggcatcaacatgctgctcaacaacggcttcagggagtcggaccagcttttcaaacaatacagaaaaagttttttgacttctgagaaaacctcagcgcttcctggagaaactcaaaggcgcttgtaagagatgttgagtcagcaggcctctgagcctcttctctgcctaaaaccatgtcagattcttgggaggactggaaggacttgcaggctgtccatgatttctagacaagtcatctgctcacagacaagaatgtgtctctgccttgctcctggagacgataggagagtccacagatgcagagatgtaagaaaaggagaagaaatgaaaagcagaaatggtttaagggaactggcgggaaagacaggaaactcatctgttgactttttccatcctcttcaactcagtggtgtgttggaaaaaggcatcttttttcccccaactattacactgtctgaaaaggtcctaattaaatattcattaaagattca

SEQ ID NO: 419695 - DNA, 638 bp, Homo sapiens
gtgaaactccatctcaaaaaaaaaaaaaaaaagaagaatattggagtcattatacttgaatgaacagttgactcattgctatgtctacagtgaattgttttaattaacatagcctcctattataccattttctgcctgcgtatatataaacacagattttatgggataatgtgtttttcttatagactgtaggaagaggcagagctctacttcttcaagcaaaggtaaatatcctgaatctacctttctccagtggcccttcttatcccatacactgtatacctgagtctgaattcaagaaagtttgtgcaatgatgttctggttggtaatatttctggaaaggaaaaatgacaaccaattgaatcagtgagctcttgagttttaagggacattacaagatcataaggaacttcgatgaaattgttcatcctgctttagaaacactcttagtctttgggtgggaagataacttttgattttataactatgtccctgaattaagaatttctaatagcaacttatattgagcacaacataagactactttttcaagaataactcgaggaaaattgtccaaagagaaccttattgacattcagttgacgtttttaaaaatgaatacaaagtttgaggtttg

SEQ ID NO: 419696 - DNA, 584 bp, Homo sapiens
gtgaaactccatctcaaaaaaaaaaaaaaaaagaagaatattggagtcattatacttgaatgaacagttgactcattgctatgtctacagtgaattgttttaattaacatagcctcctattataccattttctgcctgcgtatatataaacacagattttatgggataatgtgtttttcttatagactgtaggaagaggcagagctctacttcttcaagcaaaggtaaatatcctgaatctacctttctccagtggcccttcttatcccatacactgtatacctgagtctgaattcaagaaagtttgtgcaatgatgttctggttggtaatatttctggaaaggaatcataaggaacttcgatgaaattgttcatcctgctttagaaacactcttagtctttgggtgggaagataacttttgattttataactatgtccctgaattaagaatttctaatagcaacttatattgagcacaacataagactactttttcaagaataactcgaggaaaattgtccaaagagaaccttattgacattcagttgacgtttttaaaaatgaatacaaagtttgaggtttg

SEQ ID NO: 419697 - DNA, 409 bp, Homo sapiens
cctagcattcaaattacagtcatacatctcttaatgacatgctgagaaatgcgttgttaggcaattccttccttgtgcaaacatcatagagtacttacacagacctaggtggtatcacctactacacaaccaggctgtatctatagcctattgcttctgtgctataattgtgtacagcatgttactgtattgaatactgtaggcaaccgtaacacaatggtaagtatttgtgtatctaaatatagaaaaagtatagtaaaaatacagtttttaaaagttaaaatatggccaggctcagtggctcatgcctgtaatcccagcagtttgggaggctgaggtgggagtatcacttgagcccagaagttcaaaaccaacctgggcaacaaagtgaaacctcatctctgcaaaa

SEQ ID NO: 419698 - DNA, 2444 bp, Homo sapiens
ggattccgcttcggggcccgcgcgagttgggtgcttcggagggcgcgagaggagcgggcgggtgctgctgagtaatccccgcggcggcggccggacgcccacctcccacgccgcgccgcagccgggccgcggctcctccctccgcggtccttccctcctcttccctcccgtcttctcccctcccctcccctcccctcccggctccgcttggctccgggcaggtagagccgggctccgggcgcgcgcggggccgcagcagctgctcccgatctcgcctcggcccagcgcagggcctcgcacgcccatggccggctcggagcagcatgcggccgcggcggcgggacgacggagactcggacgcggcagcggcggcggcggcgcccctgcaggacgcggagctggccctggccggcatcaacatgctgctcaacaacggcttcagggagtcggaccagcttttcaaacaatacagaaatcatagcccactaatgagttttggagccagctttgtcagttttttgaatgccatgatgacatttgaggaagaaaaaatgcagttggcatgtgatgacttaaaaaccacagaaaaactgtgtgaaagtgaagaggctggagtaattgaaacaatcaagaataaaattaagaagaacgttgatgtccgaaaatccgccccctctatggttgatcggcttcagaggcagataatcatagctgactgccaggtttacctggctgtgctttcatttgtaaaacaagaattgtcagcttatatcaaaggtgggtggatccttaggaaagcctggaagatttacaataaatgctatctggacatcaatgcccttcaggagctgtatcagaagaagctaactgaagagtccttgacttctgatgctgcaaatgataatcacattgtggctgaaggggtgtctgaggagtctctgaacagactgaaaggtgctgttagctttggatatggcctttttcacctttgcatatccatggtgcccccaaacctgctcaaaatcatcaacctgctgggttttcctggagaccgcctacaggggctttcttcactgatgtatgcaagcgaaaattagctctgctctggtatcatactgtagtccgcccgttttttgccttggatggcagtgataacaaggcaggcctggatgaagctaaggaaattctccttaaaaaagaagctgcttatccaaattcttccctctttatgtttttcaagggacggatacaacgactagagtgtcaaatcaacagtgccttgacatctttccacactgctttggaacttgcagtagaccagagagaaattcaacatgtctgtctgtatgaaattggttggtgcagcatgatagagctcaatttcaaggatgcatttgattcctttgagaggctaaaaaatgagtccaggtggtcccagtgctattatgcctacttgactgcagtttgtcagggagccactggtgatgtggatggggcacagattgtctttaaagaagttcagaaactcttcaaaaggaaaaacaatcagattgaacagttctcggtgaaaaagcgtctattgaagtgttgtacttgtggaaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataatttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaagctcttgtgaagatgggcttttcttctgaaaaccacctgtgccagggacacattttcccagttaagctgacatattaaagatctcctcttttaaacatgtagctgaaaagtaataatgatgttgaggaggatgatgatggtaataataactaaccacctggggagagggttaagtgaccttgctcaaacgttttagttttgtgatttattatttttaaaataaaatcaaacggaacatccaacccaagatcctgtaggaacacctaccttaagcacatatctgaatgggtaacatgatgaggtacctgtaaaattattaacaatatcatgacatagcatttatatttgtgttttgaaaaaataaaagtgctttctagtgttttactttatcctc

SEQ ID NO: 419699 - DNA, 2493 bp, Homo sapiens
ggattccgcttcggggcccgcgcgagttgggtgcttcggagggcgcgagaggagcgggcgggtgctgctgagtaatccccgcggcggcggccggacgcccacctcccacgccgcgccgcagccgggccgcggctcctccctccgcggtccttccctcctcttccctcccgtcttctcccctcccctcccctcccctcccggctccgcttggctccgggcaggtagagccgggctccgggcgcgcgcggggccgcagcagctgctcccgatctcgcctcggcccagcgcagggcctcgcacgcccatggccggctcggagcagcatgcggccgcggcggcgggacgacggagactcggacgcggcagcggcggcggcggcgcccctgcaggacgcggagctggccctggccggcatcaacatgctgctcaacaacggcttcagggagtcggaccagcttttcaaacaatacagaaatcatagcccactaatgagttttggagccagctttgtcagttttttgaatgccatgatgacatttgaggaagaaaaaatgcagttggcatgtgatgacttaaaaaccacagaaaaactgtgtgaaagtgaagaggctggagtaattgaaacaatcaagaataaaattaagaagaacgttgatgtccgaaaatccgccccctctatggttgatcggcttcagaggcagataatcatagctgactgccaggtttacctggctgtgctttcatttgtaaaacaagaattgtcagcttatatcaaaggtgggtggatccttaggaaagcctggaagatttacaataaatgctatctggacatcaatgcccttcaggagctgtatcagaagaagctaactgaagagtccttgacttctgatgctgcaaatgataatcacattgtggctgaaggggtgtctgaggagtctctgaacagactgaaaggtgctgttagctttggatatggcctttttcacctttgcatatccatggtgcccccaaacctgctcaaaatcatcaacctgctgggttttcctggagaccgcctacaggggctttcttcactgatgtatgcaagcgaaaattagctctgctctggtatcatactgtagtccgcccgttttttgccttggatggcagtgataacaaggcaggcctggatgaagctaaggaaattctccttaaaaaagaagctgcttatccaaattcttccctctttatgtttttcaagggacggatacaacgactagagtgtcaaatcaacagtgccttgacatctttccacactgctttggaacttgcagtagaccagagagaaattcaacatgtctgtctgtatgaaattggttggtgcagcatgatagagctcaatttcaaggatgcatttgattcctttgagaggctaaaaaatgagtccaggtggtcccagtgctattatgcctacttgactgcagtttgtcagggagccactggtgatgtggatggggcacagattgtctttaaagaagttcagaaactcttcaaaaggaaaaacaatcagattgaacagttctcggtgaaaaaggcagagcgatttcggaagcaaaccccaaccaaagcgctctgtgtgttggcgtctattgaagtgttgtacttgtggaaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataatttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaagctcttgtgaagatgggcttttcttctgaaaaccacctgtgccagggacacattttcccagttaagctgacatattaaagatctcctcttttaaacatgtagctgaaaagtaataatgatgttgaggaggatgatgatggtaataataactaaccacctggggagagggttaagtgaccttgctcaaacgttttagttttgtgatttattatttttaaaataaaatcaaacggaacatccaacccaagatcctgtaggaacacctaccttaagcacatatctgaatgggtaacatgatgaggtacctgtaaaattattaacaatatcatgacatagcatttatatttgtgttttgaaaaaataaaagtgctttctagtgttttactttatcctc

SEQ ID NO: 419700 - DNA, 2340 bp, Homo sapiens
ggattccgcttcggggcccgcgcgagttgggtgcttcggagggcgcgagaggagcgggcgggtgctgctgagtaatccccgcggcggcggccggacgcccacctcccacgccgcgccgcagccgggccgcggctcctccctccgcggtccttccctcctcttccctcccgtcttctcccctcccctcccctcccctcccggctccgcttggctccgggcaggtagagccgggctccgggcgcgcgcggggccgcagcagctgctcccgatctcgcctcggcccagcgcagggcctcgcacgcccatggccggctcggagcagcatgcggccgcggcggcgggacgacggagactcggacgcggcagcggcggcggcggcgcccctgcaggacgcggagctggccctggccggcatcaacatgctgctcaacaacggcttcagggagtcggaccagcttttcaaacaatacagaaatcatagcccactaatgagttttggagccagctttgtcagttttttgaatgccatgatgacatttgaggaagaaaaaatgcagttggcatgtgatgacttaaaaaccacagaaaaactgtgtgaaagtgaagaggctggagtaattgaaacaatcaagaataaaattaagaagaacgttgatgtccgaaaatccgccccctctatggttgatcggcttcagaggcagataatcatagctgactgccaggtttacctggctgtgctttcatttgtaaaacaagaattgtcagcttatatcaaaggtgggtggatccttaggaaagcctggaagatttacaataaatgctatctggacatcaatgcccttcaggagctgtatcagaagaagctaactgaagagtccttgacttctgatgctgcaaatgataatcacattgtggctgaaggggtgtctgaggagtctctgaacagactgaaaggtgctgttagctttggatatggcctttttcacctttgcatatccatggtgcccccaaacctgctcaaaatcatcaacctgctgggttttcctggagaccgcctacaggggctttcttcactgatgtatgcaagcgaaaattagctctgctctggtatcatactgtagtccgcccgttttttgccttggatggcagtgataacaaggcaggcctggatgaagctaaggaaattctccttaaaaaagaagctgcttatccaaattcttccctctttatgtttttcaagggacggatacaacgactagagtgtcaaatcaacagtgccttgacatctttccacactgctttggaacttgcagtagaccagagagaaattcaacatgtctgtctgtatgaaattggttggtgcagcatgatagagctcaatttcaaggatgcatttgattcctttgagaggctaaaaaatgagtccaggtggtcccagtgctattatgcctacttgactgcagtttgtcagggagccactggtgatgtggatggggcacagattgtctttaaagaagttcagaaactcttcaaaaggaaaaacaatcagattgaacagttctcggtgaaaaaggcagagcgatttcggaagcaaaccccaaccaaagcgctctgtgtgttggcgtctattgaagtgttgtacttgtggaaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataatttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaagctcttgtgaagatgggcttttcttctgaaaaccacctgtgccagggacacattttcccagttaagctgacatattaaagatctcctcttttaaacatgtagctgaaaagtaataatgatgttgaggaggatgatgatggtaataataactaaccacctggggagagggttaagtgaccttgctcaaacgttttagttttgtgatttattatttttaaaataaaatcaaacggaacatcca

SEQ ID NO: 419701 - DNA, 1268 bp, Homo sapiens
ggggtttcgccatgttggccaggctggtctcgaattcttgacctcaggtgatccactcgcctctgccttccaaagtgctgggattactggcatgaaccaccatgtccagcccattgtggaatagtctttaaacatatttgctcctgcttttttttttttcaagtatcatcacttcaggtatcccttatggcattttccctgacttgtacttaagaaatataattatggtttcttacagtttgtcagggagccactggtgatgtggatggggcacagattgtctttaaagaagttcagaaactcttcaaaaggaaaaacaatcagattgaacagttctcggtgaaaaaggcagagcgatttcggaagcaaaccccaaccaaagcgctctgtgtgttggcgtctattgaagtgttgtacttgtggaaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataatttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaagctcttgtgaagatgggcttttcttctgaaaaccacctgtgccagggacacattttcccagttaagctgacatattaaagatctcctcttttaaacatgtagctgaaaagtaataatgatgttgaggaggatgatgatggtaataataactaaccacctggggagagggttaagtgaccttgctcaaacgttttagttttgtgatttattatttttaaaataaaatcaaacggaacatccaacccaagatcctgtaggaacacctaccttaagcacatatctgaatgggtaacatgatgaggtacctgtaaaattattaacaatatcatgacatagcatttatatttgtgttttgaaaaaataaaagtgctttctagtgttttactttatcctc

SEQ ID NO: 419702 - DNA, 2329 bp, Homo sapiens
ggattccgcttcggggcccgcgcgagttgggtgcttcggagggcgcgagaggagcgggcgggtgctgctgagtaatccccgcggcggcggccggacgcccacctcccacgccgcgccgcagccgggccgcggctcctccctccgcggtccttccctcctcttccctcccgtcttctcccctcccctcccctcccctcccggctccgcttggctccgggcaggtagagccgggctccgggcgcgcgcggggccgcagcagctgctcccgatctcgcctcggcccagcgcagggcctcgcacgcccatggccggctcggagcagcatgcggccgcggcggcgggacgacggagactcggacgcggcagcggcggcggcggcgcccctgcaggacgcggagctggccctggccggcatcaacatgctgctcaacaacggcttcagggagtcggaccagcttttcaaacaatacagaaatcatagcccactaatgagttttggagccagctttgtcagttttttgaatgccatgatgacatttgaggaagaaaaaatgcagttggcatgtgatgacttaaaaaccacagaaaaactgtgtgaaagtgaagaggctggagtaattgaaacaatcaagaataaaattaagaagaaccttatatcaaaggtgggtggatccttaggaaagcctggaagatttacaataaatgctatctggacatcaatgcccttcaggagctgtatcagaagaagctaactgaagagtccttgacttctgatgctgcaaatgataatcacattgtggctgaaggggtgtctgaggagtctctgaacagactgaaaggtgctgttagctttggatatggcctttttcacctttgcatatccatggtgcccccaaacctgctcaaaatcatcaacctgctgggttttcctggagaccgcctacaggggctttcttcactgatgtatgcaagcgaaaattagctctgctctggtatcatactgtagtccgcccgttttttgccttggatggcagtgataacaaggcaggcctggatgaagctaaggaaattctccttaaaaaagaagctgcttatccaaattcttccctctttatgtttttcaagggacggatacaacgactagagtgtcaaatcaacagtgccttgacatctttccacactgctttggaacttgcagtagaccagagagaaattcaacatgtctgtctgtatgaaattggttggtgcagcatgatagagctcaatttcaaggatgcatttgattcctttgagaggctaaaaaatgagtccaggtggtcccagtgctattatgcctacttgactgcagtttgtcagggagccactggtgatgtggatggggcacagattgtctttaaagaagttcagaaactcttcaaaaggaaaaacaatcagattgaacagttctcggtgaaaaagcgtctattgaagtgttgtacttgtggaaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataatttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaagctcttgtgaagatgggcttttcttctgaaaaccacctgtgccagggacacattttcccagttaagctgacatattaaagatctcctcttttaaacatgtagctgaaaagtaataatgatgttgaggaggatgatgatggtaataataactaaccacctggggagagggttaagtgaccttgctcaaacgttttagttttgtgatttattatttttaaaataaaatcaaacggaacatccaacccaagatcctgtaggaacacctaccttaagcacatatctgaatgggtaacatgatgaggtacctgtaaaattattaacaatatcatgacatagcatttatatttgtgttttgaaaaaataaaagtgctttctagtgttttactttatcctc

SEQ ID NO: 419703 - DNA, 1267 bp, Homo sapiens
gagcccttaacacctgagcaaaggagagaacgctggaggagaaggcgggtgcgagctgagcccttaccacctgagcaaggagagtgtcaaatcaacagtgccttgacatctttccacactgctttggaacttgcagtagaccagagagaaattcaacatgtctgtctgtatgaaattggttggtgcagcatgatagagctcaatttcaaggatgcatttgattcctttgagaggctaaaaaatgagtccaggtggtcccagtgctattatgcctacttgactgcagtttgtcagggagccactggtgatgtggatggggcacagattgtctttaaagaagttcagaaactcttcaaaaggaaaaacaatcagattgaacagttctcggtgaaaaagcgtctattgaagtgttgtacttgtggaaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataatttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaagctcttgtgaagatgggcttttcttctgaaaaccacctgtgccagggacacattttcccagttaagctgacatattaaagatctcctcttttaaacatgtagctgaaaagtaataatgatgttgaggaggatgatgatggtaataataactaaccacctggggagagggttaagtgaccttgctcaaacgttttagttttgtgatttattatttttaaaataaaatcaaacggaacatccaacccaagatcctgtaggaacacctaccttaagcacatatctgaatgggtaacatgatgaggtacctgtaaaattattaacaatatcatgacatagcatttatatttgtgttttgaaaaaataaaagtgctttctagtgttttactttatcctc

SEQ ID NO: 419704 - DNA, 1219 bp, Homo sapiens
ggggtttcgccatgttggccaggctggtctcgaattcttgacctcaggtgatccactcgcctctgccttccaaagtgctgggattactggcatgaaccaccatgtccagcccattgtggaatagtctttaaacatatttgctcctgcttttttttttttcaagtatcatcacttcaggtatcccttatggcattttccctgacttgtacttaagaaatataattatggtttcttacagtttgtcagggagccactggtgatgtggatggggcacagattgtctttaaagaagttcagaaactcttcaaaaggaaaaacaatcagattgaacagttctcggtgaaaaagcgtctattgaagtgttgtacttgtggaaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataatttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaagctcttgtgaagatgggcttttcttctgaaaaccacctgtgccagggacacattttcccagttaagctgacatattaaagatctcctcttttaaacatgtagctgaaaagtaataatgatgttgaggaggatgatgatggtaataataactaaccacctggggagagggttaagtgaccttgctcaaacgttttagttttgtgatttattatttttaaaataaaatcaaacggaacatccaacccaagatcctgtaggaacacctaccttaagcacatatctgaatgggtaacatgatgaggtacctgtaaaattattaacaatatcatgacatagcatttatatttgtgttttgaaaaaataaaagtgctttctagtgttttactttatcctc

SEQ ID NO: 419705 - DNA, 935 bp, Homo sapiens
taataggagactcttggcttttaaatcctagatgataatgtccttgtaagtttaatctttcagtatgggcttatgatagttatcacagccctaaatagcttattttagatcaaatgcttatgtgctagcaagatacagtcaagacgcatgtcgagatcatagttaccttgtgtgttttctgttttaaatattaaaatgggatgtttagactcttagatgcagataaaagatgttctcagtgataaaatcaatagaggctaatatgtcccctggaaaaatagtagcacaaattaggcagtccaatatattctgaggaatgcacatcaggcagcatgtaaaggacttctaagatgtagataggaaagaatgaagatgaggaaagaagagaaaatctgatctagaaaacagagtatgagtcccccttcccgccccctcttgaagattataataagccttatgctaagtaggaaaatgaattcatccaataacatttgcattcctttcagtacttccagcgagctgttaaagatgaattgtgtcgtcagaataatttatatgttcagccgtatgcctgttatgaacttggctgtcttctattagacaaaccagaggtaagatcttatatatataatataatatatatttttaatgttgttcaacaaaaatgtggaagtgggcaagcacaaagcacccttcatttaaaacaaactgaacacagtgttcttcattttgttttccttggttttacttagaatgaatccaagaagttagtaatactaccttattatctttaaggaggtaatttcttccctagcattcaaattacagtcatacatctcttaatgacatgctgagaaatgcgttgttaggcaattccttccttgtgcaaacatcatagagtacttacacagacctaggtggtatcacctactaca

SEQ ID NO: 419706 - DNA, 613 bp, Homo sapiens
  misc_feature (337)..(337): n is a, c, g, or t
  misc_feature (441)..(441): n is a, c, g, or t
ctcgtgccgaattcggcacgaggctgttcagtacttccagcgagctgttaaagatgaattgtgtcgtcagaataatttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagagggcccaanaaaaacaaagacccaaagaacaaaaaaaaaaaaagatgaacaagggcggggaagagccccacacaatactgagactggaccaaagcagtgaacaagcagaaaanaccccctcgggggggggcccgggccccaattggccctaaagggagtggaataacaattcactgcccgcggttttacacggtggtagtggggaaacccttgctgtacccaatttaatcgctttggagaaaatcccccttttgcccggttggggtgaatggccgaagggaaatt

SEQ ID NO: 419707 - DNA, 2472 bp, Homo sapiens
ggattccgcttcggggcccgcgcgagttgggtgcttcggagggcgcgagaggagcgggcgggtgctgctgagtaatccccgcggcggcggccggacgcccacctcccacgccgcgccgcagccgggccgcggctcctccctccgcggtccttccctcctcttccctcccgtcttctcccctcccctcccctcccctcccggctccgcttggctccgggcaggtagagccgggctccgggcgcgcgcggggccgcagcagctgctcccgatctcgcctcggcccagcgcagggcctcgcacgcccatggccggctcggagcagcatgcggccgcggcggcgggacgacggagactcggacgcggcagcggcggcggcggcgcccctgcaggacgcggagctggccctggccggcatcaacatgctgctcaacaacggcttcagggagtcggaccagcttttcaaacaatacagaaatcatagcccactaatgagttttggagccagctttgtcagttttttgaatgccatgatgacatttgaggaagaaaaaatgcagttggcatgtgatgacttaaaaaccacagaaaaactgtgtgaaagtgaagaggctggagtaattgaaacaatcaagaataaaattaagaagaacgttgatgtccgaaaatccgccccctctatggttgatcggcttcagaggcagataatcatagctgactgccaggtttacctggctgtgctttcatttgtaaaacaagaattgtcagcttatatcaaaggtgggtggatccttaggaaagcctggaagatttacaataaatgctatctggacatcaatgcccttcaggagctgtatcagaagaagctaactgaagagtccttgacttctgatgctgcaaatgataatcacattgtggctgaaggggtgtctgaggagtctctgaacagactgaaaggtgctgttagctttggatatggcctttttcacctttgcatatccatggtgcccccaaacctgctcaaaatcatcaacctgctgggttttcctggagaccgcctacaggggctttcttcactgatgtatgcaagcgaaagtaaggacatgaaggcccctttagctacattagctctgctctggtatcatactgtagtccgcccgttttttgccttggatggcagtgataacaaggcaggcctggatgaagctaaggaaattctccttaaaaaagaagctgcttatccaaattcttccctctttatgtttttcaagggacggatacaacgactagagtgtcaaatcaacagtgccttgacatctttccacactgctttggaacttgcagtagaccagagagaaattcaacatgtctgtctgtatgaaattggttggtgcagcatgatagagctcaatttcaaggatgcatttgattcctttgagaggctaaaaaatgagtccaggtggtcccagtgctattatgcctacttgactgcagtttgtcagggagccactggtgatgtggatggggcacagattgtctttaaagaagttcagaaactcttcaaaaggaaaaacaatcagattgaacagttctcggtgaaaaagcgtctattgaagtgttgtacttgtggaaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataatttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaagctcttgtgaagatgggcttttcttctgaaaaccacctgtgccagggacacattttcccagttaagctgacatattaaagatctcctcttttaaacatgtagctgaaaagtaataatgatgttgaggaggatgatgatggtaataataactaaccacctggggagagggttaagtgaccttgctcaaacgttttagttttgtgatttattatttttaaaataaaatcaaacggaacatccaacccaagatcctgtaggaacacctaccttaagcacatatctgaatgggtaacatgatgaggtacctgtaaaattattaacaatatcatgacatagcatttatatttgtgttttgaaaaaataaaagtgctttctagtgttttactttatcctc

SEQ ID NO: 419708 - DNA, 2058 bp, Homo sapiens
ggattccgcttcggggcccgcgcgagttgggtgcttcggagggcgcgagaggagcgggcgggtgctgctgagtaatccccgcggcggcggccggacgcccacctcccacgccgcgccgcagccgggccgcggctcctccctccgcggtccttccctcctcttccctcccgtcttctcccctcccctcccctcccctcccggctccgcttggctccgggcaggtagagccgggctccgggcgcgcgcggggccgcagcagctgctcccgatctcgcctcggcccagcgcagggcctcgcacgcccatggccggctcggagcagcatgcggccgcggcggcgggacgacggagactcggacgcggcagcggcggcggcggcgcccctgcaggacgcggagctggccctggccggcatcaacatgctgctcaacaacggcttcagggagtcggaccagcttttcaaacaatacagaaatcatagcccactaatgagttttggagccagctttgtcagttttttgaatgccatgatgacatttgaggaagaaaaaatgcagttggcatgtgatgacttaaaaaccacagaaaaactgtgtgaaagtgaagaggctggagtaattgaaacaatcaagaataaaattaagaagaacgttgatgtccgaaaatccgccccctctatggttgatcggcttcagaggcagataatcatagctgactgccaggtttacctggctgtgctttcatttgtaaaacaagaattgtcagcttatatcaaaggtgggtggatccttaggaaagcctggaagatttacaataaatgctatctggacatcaatgcccttcaggagctgtatcagaagaagctaactgaagagtccttgacttctgatgctgcaaatgataatcacattgtggctgaaggggtgtctgaggagtctctgaacagactgaaaggtgctgttagctttggatatggcctttttcacctttgcatatccatggtgcccccaaacctgctcaaaatcatcaacctgctgggttttcctggagaccgcctacaggggctttcttcactgatgtatgcaagcgaaaattagctctgctctggtatcatactgtagtccgcccgttttttgccttggatggcagtgataacaaggcaggcctggatgaagctaaggaaattctccttaaaaaagaagctgcttatccaaattcttccctctttatgtttttcaagggacggatacaacgactagagtgtcaaatcaacagtgccttgacatctttccacactgctttggaacttgcagtagaccagagagaaattcaacatgtctgtctgtatgaaattggttggtgcagcatgatagagctcaatttcaaggatgcatttgattcctttgagaggctaaaaaatgagtccaggtggtcccagtgctattatgcctacttgactgcagtttgtcagggagccactggtgatgtggatggggcacagattgtctttaaagaagttcagaaactcttcaaaaggaaaaacaatcagattgaacagttctcggtgaaaaagcgtctattgaagtgttgtacttgtggaaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataatttatatgttcagccgtatgcctgttatgaacttggctgtcttctattagacaaaccagagactgtaggaagaggcagagctctacttctgtagctcaggagagcacccctccaccccatttgctcgcagtatcctagaatctttgtgctctcgctgcagttccctttgggttccatgttttccttgttccctccccacaacgagccacgcaaagagccccccgaggtgccccaccaagagccaccccaggagccccaccgagccgca

SEQ ID NO: 419709 - DNA, 1951 bp, Homo sapiens
gtttcctccaactggacgttaagttactgagaacaggaatcagggatgcgattggtgcgtgtcttctgtggctacctggtcagcattcataaacggtgataatggattgaatgctgcagtttcaaccttcctgacaacagaggagagtgttactttggggcatgaacagttattgatccagctgggccttggttaatgagtcatttggcttacagtgttcccgagtcacaggctgtcctgaagatcacctgctgactcattggtgcccttgtttccccgaggcctcctgcagtgacgtgctgaggagaggagcccaggtctgcgggtgggggacccgtcctctgagaagcctgcagcttctcctccaggacccttccagcccacctggctggctgtggggataatgggcacttgggagcattggagggggaggaagcatagagaaagcagcaggagacgcacctggaagcccaggggagggaagtccacctccctgcaagtgtagggcagtgagaggagccctggcaccagcagagcaagaaagaaatgcatgcaccgttcagaataagctgtcaggtcgtctggctgtttaagatttatttattaatggtatgtgacatttagcatttctcaatgcctaagattaaactaatgctttgaatcctgatcatgcttttgagctgctcctcttgggtacttgtggcatcgtgttggcagaccctgagtgacatcttcagcggcgggaaaacgaaatgtatttcactgggatgtcaaatcaacagtgccttgacatctttccacactgctttggaacttgcagtagaccagagagaaattcaacatgtctgtctgtatgaaattggttggtgcagcatgatagagctcaatttcaaggatgcatttgattcctttgagaggctaaaaaatgagtccaggtggtcccagtgctattatgcctacttgactgcagtttgtcagggagccactggtgatgtggatggggcacagattgtctttaaagaagttcagaaactcttcaaaaggaaaaacaatcagattgaacagttctcggtgaaaaagcgtctattgaagtgttgtacttgtggaaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataatttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaagctcttgtgaagatgggcttttcttctgaaaaccacctgtgccagggacacattttcccagttaagctgacatattaaagatctcctcttttaaacatgtagctgaaaagtaataatgatgttgaggaggatgatgatggtaataataactaaccacctggggagagggttaagtgaccttgctcaaacgttttagttttgtgatttattatttttaaaataaaatcaaacggaacatccaacccaagatcctgtaggaacacctaccttaagcacatatctgaatgggtaacatgatgaggtacctgtaaaattattaacaatatcatgacatagcatttatatttgtgttttgaaaaaataaaagtgctttctagtgttttactttatcctc

SEQ ID NO: 419710 - DNA, 729 bp, Homo sapiens
ctcgtgccgaattcggcacgaggctgttcagtacttccagcgagctgttaaagatgaattgtgtcgtcagaataatttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaagctcttgtgaagatgggcttttcttctgaaaaccacctgtgccagggacacattttcccagttaagctgacatattaaagatctcctcttttaaacatgtagctgaaaagtaataatgatgttgaggaggatgatgatggtaataataactaaccacctggggagagggttaagtgaccttgctcaaacgttttagttttgtgatttattatttttaaaataaaatcaaacggaacatccaacccaagatcctgtaggaacacctaccttaagcacatatctgaatgggtaacatgatgaggtacctgtaaaattattaacaatatcatgacatagcatttatatttgtgttttgaaaaaataaaagtgctttctagtgttttactttatcctc

SEQ ID NO: 419711 - DNA, 3032 bp, Homo sapiens
  misc_feature (1190)..(1190): n is a, c, g, or t
ggggctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagntaaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttggcaattttacatttggaattttatcactgtgcttttttatatgaggcactgtagtattttcacatagtatagtactctggatgtaaaagctcaaaaattgtgattccttgaacgttcactaaatcttcaagcaaaaacacatttttacattatttttacgttgattattttagtgaaagaccatatgaagaagcatttttaatattaacttgttacatactttgatccactttacatcatttttatgttgttgaggtagggaaattagggttcagtttatcactggacattcaggaggcaagtcaatcttttttatttccttataaaattaactcttcaaaagctgttaaacagagagttatcttaatttttattgcagtaggaggaaatatatttaaaatatttgtagatttatagcaaatagagactcgttatttaaaggttaaataacaatttgttcttttgttgtttttgccagtttagggcagtagctgcttttgtcataaatatcttcctaccacatcaaaaatgctgcttttaaaatttttgtttataaattgagaaggaattttctctctataagtttctgtcattgaacagatcaccattaaaaagaatattagaatccagcatgaagataatggctaataaaaatgaggtacatactttataaaaccattaatcagatttgaatgaggaatgcttcccacatccttgaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaagtgccactgtgtggaacatttttcttttttttaatattggactttccaattttgaaattatggataaagtcctaaattttctatagtggcttcttttctgtctgcatattttgttaaaattgtggatctaaaagccatatcctgtctttggtggtggcctggtaggaatggcttgtcctagttcttcaaaggtaagattgaccaaagcaagttctcattggtggtctgtgtttacatcttccgtgtcaagatattttaaagcatgaaaataaagccattcttgccctttttcgtgtgtttgaaa

SEQ ID NO: 419712 - DNA, 2253 bp, Homo sapiens
  misc_feature (1190)..(1190): n is a, c, g, or t
ggggctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagntaaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttggcaattttacatttggaattttatcactgtgcttttttatatgaggcactgtagtattttcacatagtatagtactctggatgtaaaagctcaaaaattgtgattccttgaacgttcactaaatcttcaagcaaaaacacatttttacattatttttacgttgattattttagtgaaagaccatatgaagaagcatttttaatattaacttgttacatactttgatccactttacatcatttttatgttgttgaggtagggaaattagggttcagtttatcactggacattcaggagaacgcgtcaggagacgcgtcaaatcgaagccgaattctgcaatatcatcacactgcgccgctcgacatgatctagagcccattccctatatgtcat

SEQ ID NO: 419713 - DNA, 2595 bp, Homo sapiens
  misc_feature (1190)..(1190): n is a, c, g, or t
ggggctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagntaaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttggcaattttacatttggaattttatcactgtgcttttttatatgaggcactgtagtattttcacatagtatagtactctggatgtaaaagctcaaaaattgtgattccttgaacgttcactaaatcttcaagcaaaaacacatttttacattatttttacgttgattattttagtgaaagaccatatgaagaagcatttttaatattaacttgttacatactttgatccactttacatcatttttatgttgttgaggtagggaaattagggttcagtttatcactggacattcaggaggcaagtcaatcttttttatttccttataaaattaactcttcaaaagctgttaaacagagagttatcttaatttttattgcagtaggaggaaatatatttaaaatatttgtagatttatagcaaatagagactcgttatttaaaggttaaataacaatttgttcttttgttgtttttgccagtttagggcagtagctgcttttgtcataaatatcttcctaccacatcaaaaatgctgcttttaaaatttttgtttataaattgagaaggaattttctctctataagtttctgtcattgaacagatcaccattaaaaagaatattagaatccagcatgaagataatggctaataaaaatgaggtacatactttatccagcttaaagctgattcatgagaacgcttccagatatagctgtttcctgctgatcagctttcc

SEQ ID NO: 419714 - DNA, 2916 bp, Homo sapiens
  misc_feature (1190)..(1190): n is a, c, g, or t
ggggctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagntaaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttggcaattttacatttggaattttatcactgtgcttttttatatgaggcactgtagtattttcacatagtatagtactctggatgtaaaagctcaaaaattgtgattccttgaacgttcactaaatcttcaagcaaaaacacatttttacattatttttacgttgattattttagtgaaagaccatatgaagaagcatttttaatattaacttgttacatactttgatccactttacatcatttttatgttgttgaggtagggaaattagggttcagtttattgaacagatcaccattaaaaagaatattagaatccagcatgaagataatggctaataaaaatgaggtacatactttataaaaccattaatcagatttgaatgaggaatgcttcccacatccttgaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaagtgccactgtgtggaacatttttcttttttttaatattggactttccaattttgaaattatggataaagtcctaaattttctatagtggcttcttttctgtctgcatattttgttaaaattgtggatctaaaagccatatcctgtctttggtggtggcctggtaggaatggcttgtcctagttcttcaaaggtaagattgaccaaagcaagttctcattggtggtctgtgtttacatcttccgtgtcaagatattttaaagcatgaaaataaagccattcttgccctttttcgtgtgtttgaaaaaacaacaaaaaacacagaaaaaaaatttttttgggcggccgggacccgaaaaaagttttaaacccaatctcgggtgggggccgggccccacatagggttatggacaacatggggacacaacgtgcccaaggaaacccgggcctacacaagggtgggttctcaccaaaaaaacgcgcggggaccgcggtcttggaac

SEQ ID NO: 419715 - DNA, 1009 bp, Homo sapiens
ttacgtttatgtaaggattgactcaatgtgagcacatttactaaaattaaagaatctagggaaaactctggtactaagtactgaccagggaaggtatctcctggcacacagctcagagcttctgggttctactatggcaaggaattagcctgatgctgttaaacatctcaattacacaagcaactctacccctgaacttttcttgctcatcagactttttttattgggggagtgggggaacagagtctcactctgtcgcccaggctggagtactgtggccagatctcgactcactgcaacctctgcctcctgggttcaagtgattctcctgcttttgtcataaatatcttcctaccacatcaaaaatgctgcttttaaaatttttgtttataaattgagaaggaattttctctctataagtttctgtcattgaacagatcaccattaaaaagaatattagaatccagcatgaagataatggctaataaaaatgaggtacatactttataaaaccattaatcagatttgaatgaggaatgcttcccacatccttgaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaagtgccactgtgtggaacatttttcttttttttaatattggactttccaattttgaaattatggataaagtcctaaattttctatagtggcttcttttctgtctgcatattttgttaaaattgtggatctaaaagccatatcctgtctttggtggtggcctggtaggaatggcttgtcctagttcttcaaaggtaagattgaccaaagcaagttctcattggtggtctgtgtttacatcttccgtgtcaagatattttaaagcatgaaaataaagccattcttgccctttttcgtgtgtttgaaa

SEQ ID NO: 419716 - DNA, 817 bp, Homo sapiens
ggaataacagtctgagctagcaccaccctcagccaggctacaacgacagcactgaagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaagtgccactgtgtggaacatttttcttttttttaatattggactttccaattttgaaattatggataaagtcctaaattttctatagtggcttcttttctgtctgcatattttgttaaaattgtggatctaaaagccatatcctgtctttggtggtggcctggtaggaatggcttgtcctagttcttcaaaggtaagattgaccaaagcaagttctcattggtggtctgtgtttacatcttccgtgtcaagatattttaaagcatgaaaataaagccattcttgccctttttcgtgtgtttgaaatggtcgcattggtgtcatatttacatgagaaagtatcttacgcaattttccaaagtagaattgttaatgttatttaagtacttttataatcttcccactgaaaaatatagtttcccactaacct

SEQ ID NO: 419717 - DNA, 2731 bp, Homo sapiens
  misc_feature (1190)..(1190): n is a, c, g, or t
ggggctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagntaaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttggcaattttacatttggaattttatcactgtgcttttttatatgaggcactgtagtattttcacatagtatagtactctggatgtaaaagctcaaaaattgtgattccttgaacgttcactaaatcttcaagcaaaaacacatttttacattatttttacgttgattattttagtgaaagaccatatgaagaagcatttttaatattaacttgttacatactttgatccactttacatcatttttatgttgttgaggtagggaaattagggttcagtttatcactggacattcaggaggcaagtcaatcttttttatttccttataaaattaactcttcaaaagctgttaaacagagagttatcttaatttttattgcagtaggaggaaatatatttaaaatatttgtagatttatagcaaatagagactcgttatttaaaggttaaataacaatttgttcttttgttgtttttgccagtttagggcagtagctgcttttgtcataaatatcttcctaccacatcaaaaatgctgcttttaaaatttttgtttataaattgagaaggaattttctctctataagtttctgtcattgaacagatcaccattaaaaagaatattagaatccagcatgaagataatggctaataaaaatgaggtacatactttataaaaccattaatcagatttgaatgaggaatgcttcccacatccttgaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaagtg

SEQ ID NO: 419718 - DNA, 3156 bp, Homo sapiens
  misc_feature (1190)..(1190): n is a, c, g, or t
ggggctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagntaaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttggcaattttacatttggaattttatcactgtgcttttttatatgaggcactgtagtattttcacatagtatagtactctggatgtaaaagctcaaaaattgtgattccttgaacgttcactaaatcttcaagcaaaaacacatttttacattatttttacgttgattattttagtgaaagaccatatgaagaagcatttttaatattaacttgttacatactttgatccactttacatcatttttatgttgttgaggtagggaaattagggttcagtttatcactggacattcaggaggcaagtcaatcttttttatttccttataaaattaactcttcaaaagctgttaaacagagagttatcttaatttttattgcagtaggaggaaatatatttaaaatatttgtagatttatagcaaatagagactcgttatttaaaggttaaataacaatttgttcttttgttgtttttgccagtttagggcagtagctgcttttgtcataaatatcttcctaccacatcaaaaatgctgcttttaaaatttttgtttataaattgagaaggaattttctctctataagtttctgtcattgaacagatcaccattaaaaagaatattagaatccagcatgaagataatggctaataaaaatgaggtacatactttataaaaccattaatcagatttgaatgaggaatgcttcccacatccttgaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaagtgccactgtgtggaacatttttcttttttttaatattggactttccaattttgaaattatggataaagtcctaaattttctatagtggcttcttttctgtctgcatattttgttaaaattgtggatctaaaagccatatcctgtctttggtggtggcctggtaggaatggcttgtcctagttcttcaaaggtaagattgaccaaagcaagttctcattggtggtctgtgtttacatcttccgtgtcaagatattttaaagcatgaaaataaagccattcttgccctttttcgtgtgtttgaaatggtcgcattggtgtcatatttacatgagaaagtatcttacgcaattttccaaagtagaattgttaatgttatttaagtacttttataatcttcccactgaaaaatatagtttcccactaacct

SEQ ID NO: 419719 - DNA, 2719 bp, Homo sapiens
  misc_feature (1190)..(1190): n is a, c, g, or t
ggggctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagntaaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttggcaattttacatttggaattttatcactgtgcttttttatatgaggcactgtagtattttcacatagtatagtactctggatgtaaaagctcaaaaattgtgattccttgaacgttcactaaatcttcaagcaaaaacacatttttacattatttttacgttgattattttagtgaaagaccatatgaagaagcatttttaatattaacttgttacatactttgatccactttacatcatttttatgttgttgaggtagggaaattagggttcagtttattgaacagatcaccattaaaaagaatattagaatccagcatgaagataatggctaataaaaatgaggtacatactttataaaaccattaatcagatttgaatgaggaatgcttcccacatccttgaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaagtgccactgtgtggaacatttttcttttttttaatattggactttccaattttgaaattatggataaagtcctaaattttctatagtggcttcttttctgtctgcatattttgttaaaattgtggatctaaaagccatatcctgtctttggtggtggcctggtaggaatggcttgtcctagttcttcaaaggtaagattgaccaaagcaagttctcattggtggtctgtgtttacatcttccgtgtcaagatattttaaagcatgaaaataaagccattcttgccctttttcgtgtgtttgaaa

SEQ ID NO: 419720 - DNA, 882 bp, Homo sapiens
cacatcctggaagagtggcctaggacagctcctctcctgccagagctaggcaggcgccgaagtagccgcatggccccgtcagaagatcccagggactggagagccaacctcaaaggcaccatccgtgagacaggcctggagaccagctccggtgggaagctggctggccatcagaagaccgtccccacggctcacctgacttttgttattgactgcatccacgggaagcagctctccctggcagcaaccgcatcaccaccccaagcccccagtcccaatcgagggcttgtcaccccaccaatgaagacttacatcgtgttctgtggggaaaactggccccatctgactcgggtgacccccatgggtgggggatgccttgcccaggccagggccaccctgccgctctgcagagggtctgtggcctcagcttccttcccagtcagcccgctctgcccccaggaggttcccgaggctaaggggaaacccgtgaaggctgcgcctgtgaggtcttcaacttggggaacagtcaaggactcactgaaagccctctcctcttgtgtctgtgggcaggccgattagctggccctgcttccccagctaagcaggagtcttttgtgcttgagccaaggaaacatcattagatccgctaaggggcatctgaaacatccgtcgagtggcagaggcaggataagtcacctgcacatgaagagactcattcattcatacagcaaatattactggtacatcttccacatgccaggccctgcaaagtgctggggagataccatggttttcctggagctggtatttttggggtggagggaacccaccctgaataaataaagtaacccaataaataaagaagatgattttgaacagcga

SEQ ID NO: 419721 - DNA, 836 bp, Homo sapiens
ctctcttccttccctcgcttcatgcccctcttcccagacacacaaaaaaaaaggtccaggtgggaagctggctggccatcagaagaccgtccccacggctcacctgacttttgttattgactgcatccacgggaagcagctctccctggcagcaaccgcatcaccaccccaagcccccagtcccaatcgagggcttgtcaccccaccaatgaagacttacatcgtgttctgtggggaaaactggccccatctgactcgggtgacccccatgggtgggggatgccttgcccaggccagggccaccctgccgctctgcagagggtctgtggcctcagcttccttcccagtcagcccgctctgcccccaggaggttcccgaggctaaggggaaacccgtgaaggctgcgcctgtgaggtcttcaacttggggaacagtcaaggactcactgaaagccctctcctcttgtgtctgtgggcaggccgattagctggaagggccgggctctgatgcccagaggctgcaattcccagggcctggccctgcttccccagctaagcaggagtcttttgtgcttgagccaaggaaacatcattagatccgctaaggggcatctgaaacatccgtcgagtggcagaggcaggataagtcacctgcacatgaagagactcattcattcatacagcaaatattactggtacatcttccacatgccaggccctgcaaagtgctggggagataccatggttttcctggagctggtatttttggggtggagggaacccaccctgaataaataaagtaacccaataaataaagaagatgattttgaacagcga

SEQ ID NO: 419722 - DNA, 3317 bp, Homo sapiens
ggctaggtagaggctggggttcaatcggccaagccgtgagccgaccagaaggccgtcctctttgatatcttttgcaattgtaccgaaagtgacttactcctctgcccttcctgcttccgtctcttgccggtgccgtggtgtcgtccgtgcctggtgaggttttgtgcagcggtaaagtgctggtgcttctggtgacctttgacctgtgggtgtcacttcttgtgtctgttttcccgtgttcgttttttgggtttagttgtgcttttgcttctgctggcttgctggacctgggctggggtgccaagtggcgcctgctgcgtcagagctcaaggaatctgtgcccaccaccagctcctggtccgtaggaggtgagacatggggttctgtcatgcccccctccactgagccttggctacatctgtgtctagggcttgggctgatctagtggcggggtaggtgaaactggggtcccttggggcgccccacgctgcttccacacccaccacctctggccttgggtggtggcattacagggatgagggagtcactgtgggtggccacagggctatggccaagcgttccctggccgtcttcctctggcctcagctttgttcctataggctgcccgcgccgtgggctgcaggtctcgccgcccgcttgatccctgaggtgtttccatgctgcgggtggtgcttccaggcagagtgggtgggggcccaccgggcaccgccctttcttccttgtccctgcctcactctgagagccttgggggtctccaccagtgcagacaagggctacagtctccagggccgggtcttgtccctcttctccgctggtccacgctggcagctcttggcttcgggcctgccttctgcctccctttgggatctgtgtcttccagggatcagctgcttggcttctgctggaggtgcctccctgtgggggcgcagcctgcctcctgctctcagttcctcgccagaggctgctgcccttcctggctgggctcaggaggctccttgtaggcatatgatggggagggggtgcccctacccacctccaagaggctacagccctgtgtctggccatgtgagccctggcctttcaccgggttgctggtttcttttctgtggggcccagacttctgtaaagcacacagatgtgggtaagatgaaaaactgtggcccaacagggcttaaccctatggatggtgggatttttatccaatagtttggcctggtgtgcccacaggatgggaacagggaggcaccatcaacacttgtcatgttaatgagcttttctttgctcgaggtgttcagagacaagtcctgtgtctacctgcgtcagcctgaaaatggaaatattggctgttgactcttgtcatttagtgacttcatccccctcccctcagtctgatcttgtctaagtagaatccaggcgttagttggaatcatatcataagtatccatgaagaaaacgtcatgatctgcctcggagtggggagaaacaggccctccttgtccttgtgcagcccccacttttgtcctggctgtgggtggccatccattttgagcacctctgccaggctgcagacctggaggcgaagggagtgtggaagaggagggtgtaagggtcgacgcgtgctgaatgggaggtgcaggtcctcggtgcgttggcagaagaggcttctggagtttcgaggccatacctcctttcaagagctttggatttggggcgacttccctgggtctaggggagtgttcctgtcccctgtcaggtcagccctgcggagccactccacccctcttccccttcccctggatttcctgacatagatggtgtgttcatgtgcaggtgtgagtgtgctgtccttctgatctctgttgatcccgctttcctactgagagggtggtggagagggtggtggtctcttctcacctcagtttttctgacacagcgaatcgagggctttggccaaggccaggtctctcaaacttgtccgccaagtaaaccatgatatatgtcttcccttccaccttaactttgccccaactcctcttttatcctaacatggacgctcagatttcagaggaatacccagcagggacaggtcagctctcaccaggagagtgaggcccctggctgctgctcggggtggcactggtgttgctggctcagctcttggtgcatgtttcagatatgtgtgtacacttctgactggtgatcagggcccggcccacggccctgagcggctgcagcctgctttgggacgatggtcaggtcccatgttgtccctgctgcctccctctggagtggccacttggccaaagcgcccatccacatctggaaagtcggagccgcagcctgctgcaccgtttccgctctgggatcttgtgagttacttttttaggctgtggtttggtgaaaggaaccaacacattaacgatttttcccccagaagccactgaataattctttttggtgtatttttgccttcctgttggctgtctggccttggagcaggtcgggagagtagagtacataatcagtgccacacagaggcagggcgtgtctgagagactaatgcctgtcctgcctctggcctgtgtcctgggtgtgtaccatacctgctgggccagtcccacacatttccaccctgcccctggagcagcagctttgataccatgggtgtcccttgagtctgagctagagtgtgtccccgataaactgtgagacctccctgttcttggtgaccccagttgggctttggcccctccagcaaccttgtgtcccagccctgcccttcttcccaccccctcaatctgctagtccctgaagcctttaaccaaacgggagtgggcacagaaagccttctcctggcaacaggacaagggctgcccgcgtgtccagccctgttgctctcctggcgctgagaggtgggtccaagcagagttgatcagtccctgcctgccctgcctaggtctagccaggggaggttgtgtgtgtgggagaagaccccgggatctgctggggtgggatggaggttattaaagatctaagtgaggaggggctggggtttggatgcggggtgaggcccgagcgctcacacttcgtgtagggcgggcaggggcctgacctcttgcagggcagtggccttggtgccctacccctgccctgcgcagtatttattgctaaattattgtccaggaggggcagcactgggcctggccccccgggtatttattgctgtacatagtgtatgtttgtgatatataaggttttctttattttgtatatgatcaataaaccttttaaagaga

SEQ ID NO: 419723 - DNA, 2576 bp, Homo sapiens
agcggatcctgggatgaggaacgtcactgggtctccaccagtgcagacaagggctacagtctccagggccgggtcttgtccctcttctccgctggtccacgctggcagctcttggcttcgggcctgccttctgcctccctttgggatctgtgtcttccagggatcagctgcttggcttctgctggaggtgcctccctgtgggggcgcagcctgcctcctgctctcagttcctcgccagaggctgctgcccttcctggctgggctcaggaggctccttgtaggcatatgatggggagggggtgcccctacccacctccaagaggctacagccctgtgtctggccatgtgagccctggcctttcaccgggttgctggtttcttttctgtggggcccagacttctgtaaagcacacagatgtgggtaagatgaaaaactgtggcccaacagggcttaaccctatggatggtgggatttttatccaatagtttggcctggtgtgcccacaggatgggaacagggaggcaccatcaacacttgtcatgttaatgagcttttctttgctcgaggtgttcagagacaagtcctgtgtctacctgcgtcagcctgaaaatggaaatattggctgttgactcttgtcatttagtgacttcatccccctcccctcagtctgatcttgtctaagtagaatccaggcgttagttggaatcatatcataagtatccatgaagaaaacgtcatgatctgcctcggagtggggagaaacaggccctccttgtccttgtgcagcccccacttttgtcctggctgtgggtggccatccattttgagcacctctgccaggctgcagacctggaggcgaagggagtgtggaagaggagggtgtaagggtcgacgcgtgctgaatgggaggtgcaggtcctcggtgcgttggcagaagaggcttctggagtttcgaggccatacctcctttcaagagctttggatttggggcgacttccctgggtctaggggagtgttcctgtcccctgtcaggtcagccctgcggagccactccacccctcttccccttcccctggatttcctgacatagatggtgtgttcatgtgcaggtgtgagtgtgctgtccttctgatctctgttgatcccgctttcctactgagagggtggtggagagggtggtggtctcttctcacctcagtttttctgacacagcgaatcgagggctttggccaaggccaggtctctcaaacttgtccgccaagtaaaccatgatatatgtcttcccttccaccttaactttgccccaactcctcttttatcctaacatggacgctcagatttcagaggaatacccagcagggacaggtcagctctcaccaggagagtgaggcccctggctgctgctcggggtggcactggtgttgctggctcagctcttggtgcatgtttcagatatgtgtgtacacttctgactggtgatcagggcccggcccacggccctgagcggctgcagcctgctttgggacgatggtcaggtcccatgttgtccctgctgcctccctctggagtggccacttggccaaagcgcccatccacatctggaaagtcggagccgcagcctgctgcaccgtttccgctctgggatcttgtgagttacttttttaggctgtggtttggtgaaaggaaccaacacattaacgatttttcccccagaagccactgaataattctttttggtgtatttttgccttcctgttggctgtctggccttggagcaggtcgggagagtagagtacataatcagtgccacacagaggcagggcgtgtctgagagactaatgcctgtcctgcctctggcctgtgtcctgggtgtgtaccatacctgctgggccagtcccacacatttccaccctgcccctggagcagcagctttgataccatgggtgtcccttgagtctgagctagagtgtgtccccgataaactgtgagacctccctgttcttggtgaccccagttgggctttggcccctccagcaaccttgtgtcccagccctgcccttcttcccaccccctcaatctgctagtccctgaagcctttaaccaaacgggagtgggcacagaaagccttctcctggcaacaggacaagggctgcccgcgtgtccagccctgttgctctcctggcgctgagaggtgggtccaagcagagttgatcagtccctgcctgccctgcctaggtctagccaggggaggttgtgtgtgtgggagaagaccccgggatctgctggggtgggatggaggttattaaagatctaagtgaggaggggctggggtttggatgcggggtgaggcccgagcgctcacacttcgtgtagggcgggcaggggcctgacctcttgcagggcagtggccttggtgccctacccctgccctgcgcagtatttattgctaaattattgtccaggaggggcagcactgggcctggccccccgggtatttattgctgtacatagtgtatgtttgtgatatataaggttttctttattttgtatatgatcaataaaccttttaaagaga

SEQ ID NO: 419724 - DNA, 3307 bp, Homo sapiens
aaaaaaaaagaaaaaaaatccctttcttgtaaacttacggacacctctttgtggctgttggagtttagtttttatatacacagagttatcagacattattgttataaacttagtttaaaaaaaagacaaaaaaaaaaaagccaagccgtgagccgaccagaaggccgtcctctttgatatcttttgcaattgtaccgaaagtgacttactcctctgcccttcctgcttccgtctcttgccggtgccgtggtgtcgtccgtgcctggtgaggttttgtgcagcggtaaagtgctggtgcttctggtgacctttgacctgtgggtgtcacttcttgtgtctgttttcccgtgttcgttttttgggtttagttgtgcttttgcttctgctggcttgctggacctgggctggggtgccaagtggcgcctgctgcgtcagagctcaaggaatctgtgcccaccaccagctcctggtccgtaggaggtgagacatggggttctgtcatgcccccctccactgagccttggctacatctgtgtctagggcttgggctgatctagtggcggggtaggtgaaactggggtcccttggggcgccccacgctgcttccacacccaccacctctggccttgggtggtggcattacagggatgagggagtcactgtgggtggccacagggctatggccaagcgttccctggccgtcttcctctggcctcagctttgttcctataggctgcccgcgccgtgggctgcaggtctcgccgcccgcttgatccctgaggtgtttccatgctgcgggtggtgcttccaggcagagtgggtgggggcccaccgggcaccgccctttcttccttgtccctgcctcactctgagagccttgggggtctccaccagtgcagacaagggctacagtctccagggccgggtcttgtccctcttctccgctggtccacgctggcagctcttggcttcgggcctgccttctgcctccctttgggatctgtgtcttccagggatcagctgcttggcttctgctggaggtgcctccctgtgggggcgcagcctgcctcctgctctcagttcctcgccagaggctgctgcccttcctggctgggctcaggaggctccttgtaggcatatgatggggagggggtgcccctacccacctccaagaggctacagccctgtgtctggccatgtgagccctggcctttcaccgggttgctggtttcttttctgtggggcccagacttctgtaaagcacacagatgtgggtaagatgaaaaactgtggcccaacagggcttaaccctatggatggtgggatttttatccaatagtttggcctggtgtgcccacaggatgggaacagggaggcaccatcaacacttgtcatgttaatgagcttttctttgctcgaggtgttcagagacaagtcctgtgtctacctgcgtcagcctgaaaatggaaatattggctgttgactcttgtcatttagtgacttcatccccctcccctcagtctgatcttgtctaagtagaatccaggcgttagttggaatcatatcataagtatccatgaagaaaacgtcatgatctgcctcggagtggggagaaacaggccctccttgtccttgtgcagcccccacttttgtcctggctgtgggtggccatccattttgagcacctctgccaggctgcagacctggaggcgaagggagtgtggaagaggagggtgtaagggtcgacgcgtgctgaatgggaggtgcaggtcctcggtgcgttggcagaagaggcttctggagtttcgaggccatacctcctttcaagagctttggatttggggcgacttccctgggtctaggggagtgttcctgtcccctgtcaggtcagccctgcggagccactccacccctcttccccttcccctggatttcctgacatagatggtgtgttcatgtgcaggtgtgagtgtgctgtccttctgatctctgttgatcccgctttcctactgagagggtggtggagagggtggtggtctcttctcacctcagtttttctgacacagcgaatcgagggctttggccaaggccaggtctctcaaacttgtccgccaagtaaaccatgatatatgtcttcccttccaccttaactttgccccaactcctcttttatcctaacatggacgctcagatttcagaggaatacccagcagggacaggtcagctctcaccaggagagtgaggcccctggctgctgctcggggtggcactggtgttgctggctcagctcttggtgcatgtttcagatatgtgtgtacacttctgactggtgatcagggcccggcccacggccctgagcggctgcagcctgctttgggacgatggtcaggtcccatgttgtccctgctgcctccctctggagtggccacttggccaaagcgcccatccacatctggaaagtcggagccgcagcctgctgcaccgtttccgctctgggatcttgtgagttacttttttaggctgtggtttggtgaaaggaaccaacacattaacgatttttcccccagaagccactgaataattctttttggtgtatttttgccttcctgttggctgtctggccttggagcaggtcgggagagtagagtacataatcagtgccacacagaggcagggcgtgtctgagagactaatgcctgtcctgcctctggcctgtgtcctgggtgtgtaccatacctgctgggccagtcccacacatttccaccctgcccctggagcagcagctttgataccatgggtgtcccttgagtctgagctagagtgtgtccccgataaactgggagtgggcacagaaagccttctcctggcaacaggacaagggctgcccgcgtgtccagccctgttgctctcctggcgctgagaggtgggtccaagcagagttgatcagtccctgcctgccctgcctaggtctagccaggggaggttgtgtgtgtgggagaagaccccgggatctgctggggtgggatggaggttattaaagatctaagtgaggaggggctggggtttggatgcggggtgaggcccgagcgctcacacttcgtgtagggcgggcaggggcctgacctcttgcagggcagtggccttggtgccctacccctgccctgcgcagtatttattgctaaattattgtccaggaggggcagcactgggcctggccccccgggtatttattgctgtacatagtgtatgtttgtgatatataaggttttctttattttgtatatgatcaataaaccttttaaagaga

SEQ ID NO: 419725 - DNA, 3226 bp, Homo sapiens
aaaaaaaaagaaaaaaaatccctttcttgtaaacttacggacacctctttgtggctgttggagtttagtttttatatacacagagttatcagacattattgttataaacttagtttaaaaaaaagacaaaaaaaaaaaagccaagccgtgagccgaccagaaggccgtcctctttgatatcttttgcaattgtaccgaaagtgacttactcctctgcccttcctgcttccgtctcttgccggtgccgtggtgtcgtccgtgcctggtgaggttttgtgcagcggtaaagtgctggtgcttctggtgacctttgacctgtgggtgtcacttcttgtgtctgttttcccgtgttcgttttttgggtttagttgtgcttttgcttctgctggcttgctggacctgggctggggtgccaagtggcgcctgctgcgtcagagctcaaggaatctgtgcccaccaccagctcctggtccgtaggaggtgagacatggggttctgtcatgcccccctccactgagccttggctacatctgtgtctagggcttgggctgatctagtggcggggtaggtgaaactggggtcccttggggcgccccacgctgcttccacacccaccacctctggccttgggtggtggcattacagggatgagggagtcactgtgggtggccacagggctatggccaagcgttccctggccgtcttcctctggcctcagctttgttcctataggctgcccgcgccgtgggctgcaggtctcgccgcccgcttgatccctgaggtgtttccatgctgcgggtggtgcttccaggcagagtgggtgggggcccaccgggcaccgccctttcttccttgtccctgcctcactctgagagccttgggggtctccaccagtgcagacaagggctacagtctccagggccgggtcttgtccctcttctccgctggtccacgctggcagctcttggcttcgggcctgccttctgcctccctttgggatctgtgtcttccagggatcagctgcttggcttctgctggaggtgcctccctgtgggggcgcagcctgcctcctgctctcagttcctcgccagaggctgctgcccttcctggctgggctcaggaggctccttgtaggcatatgatggggagggggtgcccctacccacctccaagaggctacagccctgtgtctggccatgtgagccctggcctttcaccgggttgctggtttcttttctgtggggcccagacttctgtaaagcacacagatgtgggtaagatgaaaaactgtggcccaacagggcttaaccctatggatggtgggatttttatccaatagtttggcctggtgtgcccacaggatgggaacagggaggcaccatcaacacttgtcatgttaatgagcttttctttgctcgaggtgttcagagacaagtcctgtgtctacctgcgtcagcctgaaaatggaaatattggctgttgactcttgtcatttagtgacttcatccccctcccctcagtctgatcttgtctaagtagaatccaggcgttagttggaatcatatcataagtatccatgaagaaaacgtcatgatctgcctcggagtggggagaaacaggccctccttgtccttgtgcagcccccacttttgtcctggctgtgggtggccatccattttgagcacctctgccaggctgcagacctggaggcgaagggagtgtggaagaggagggtgtaagggtcgacgcgtgctgaatgggaggtgcaggtcctcggtgcgttggcagaagaggcttctggagtttcgaggccatacctcctttcaagagctttggatttggggcgacttccctgggtctaggggagtgttcctgtcccctgtcaggtcagccctgcggagccactccacccctcttccccttcccctggatttcctgacatagatggtgtgttcatgtgcaggtgtgagtgtgctgtccttctgatctctgttgatcccgctttcctactgagagggtggtggagagggtggtggtctcttctcacctcagtttttctgacacagcgaatcgagggctttggccaaggccaggtctctcaaacttgtccgccaagtaaaccatgatatatgtcttcccttccaccttaactttgccccaactcctcttttatcctaacatggacgctcagatttcagaggaatacccagcagggacaggtcagctctcaccaggagagtgaggcccctggctgctgctcggggtggcactggtgttgctggctcagctcttggtgcatgtttcagatatgtgtgtacacttctgactggtgatcagggcccggcccacggccctgagcggctgcagcctgctttgggacgatggtcaggtcccatgttgtccctgctgcctccctctggagtggccacttggccaaagcgcccatccacatctggaaagtcggagccgcagcctgctgcaccgtttccgctctgggatcttgtgagttacttttttaggctgtggtttggtgaaaggaaccaacacattaacgatttttcccccagaagccactgaataattctttttggtgtatttttgccttcctgttggctgtctggccttggagcaggtcgggagagtagagtacataatcagtgccacacagaggcagggcgtgtctgagagactaatgcctgtcctgcctctggcctgtgtcctgggtgtgtaccatacctgctgggccagtcccacacatttccaccctgcccctggagcagcagctttgataccatgggtgtcccttgagtctgagctagagtgtgtccccgataaactgtgagacctccctgttcttggtgaccccagttgggctttggcccctccagcaaccttgtgtcccagccctgcccttcttcccaccccctcaatctgtggggtgggatggaggttattaaagatctaagtgaggaggggctggggtttggatgcggggtgaggcccgagcgctcacacttcgtgtagggcgggcaggggcctgacctcttgcagggcagtggccttggtgccctacccctgccctgcgcagtatttattgctaaattattgtccaggaggggcagcactgggcctggccccccgggtatttattgctgtacatagtgtatgtttgtgatatataaggttttctttattttgtatatgatcaataaaccttttaaagaga

SEQ ID NO: 419726 - DNA, 3429 bp, Homo sapiens
aaaaaaaaagaaaaaaaatccctttcttgtaaacttacggacacctctttgtggctgttggagtttagtttttatatacacagagttatcagacattattgttataaacttagtttaaaaaaaagacaaaaaaaaaaaagccaagccgtgagccgaccagaaggccgtcctctttgatatcttttgcaattgtaccgaaagtgacttactcctctgcccttcctgcttccgtctcttgccggtgccgtggtgtcgtccgtgcctggtgaggttttgtgcagcggtaaagtgctggtgcttctggtgacctttgacctgtgggtgtcacttcttgtgtctgttttcccgtgttcgttttttgggtttagttgtgcttttgcttctgctggcttgctggacctgggctggggtgccaagtggcgcctgctgcgtcagagctcaaggaatctgtgcccaccaccagctcctggtccgtaggaggtgagacatggggttctgtcatgcccccctccactgagccttggctacatctgtgtctagggcttgggctgatctagtggcggggtaggtgaaactggggtcccttggggcgccccacgctgcttccacacccaccacctctggccttgggtggtggcattacagggatgagggagtcactgtgggtggccacagggctatggccaagcgttccctggccgtcttcctctggcctcagctttgttcctataggctgcccgcgccgtgggctgcaggtctcgccgcccgcttgatccctgaggtgtttccatgctgcgggtggtgcttccaggcagagtgggtgggggcccaccgggcaccgccctttcttccttgtccctgcctcactctgagagccttgggggtctccaccagtgcagacaagggctacagtctccagggccgggtcttgtccctcttctccgctggtccacgctggcagctcttggcttcgggcctgccttctgcctccctttgggatctgtgtcttccagggatcagctgcttggcttctgctggaggtgcctccctgtgggggcgcagcctgcctcctgctctcagttcctcgccagaggctgctgcccttcctggctgggctcaggaggctccttgtaggcatatgatggggagggggtgcccctacccacctccaagaggctacagccctgtgtctggccatgtgagccctggcctttcaccgggttgctggtttcttttctgtggggcccagacttctgtaaagcacacagatgtgggtaagatgaaaaactgtggcccaacagggcttaaccctatggatggtgggatttttatccaatagtttggcctggtgtgcccacaggatgggaacagggaggcaccatcaacacttgtcatgttaatgagcttttctttgctcgaggtgttcagagacaagtcctgtgtctacctgcgtcagcctgaaaatggaaatattggctgttgactcttgtcatttagtgacttcatccccctcccctcagtctgatcttgtctaagtagaatccaggcgttagttggaatcatatcataagtatccatgaagaaaacgtcatgatctgcctcggagtggggagaaacaggccctccttgtccttgtgcagcccccacttttgtcctggctgtgggtggccatccattttgagcacctctgccaggctgcagacctggaggcgaagggagtgtggaagaggagggtgtaagggtcgacgcgtgctgaatgggaggtgcaggtcctcggtgcgttggcagaagaggcttctggagtttcgaggccatacctcctttcaagagctttggatttggggcgacttccctgggtctaggggagtgttcctgtcccctgtcaggtcagccctgcggagccactccacccctcttccccttcccctggatttcctgacatagatggtgtgttcatgtgcaggtgtgagtgtgctgtccttctgatctctgttgatcccgctttcctactgagagggtggtggagagggtggtggtctcttctcacctcagtttttctgacacagcgaatcgagggctttggccaaggccaggtctctcaaacttgtccgccaagtaaaccatgatatatgtcttcccttccaccttaactttgccccaactcctcttttatcctaacatggacgctcagatttcagaggaatacccagcagggacaggtcagctctcaccaggagagtgaggcccctggctgctgctcggggtggcactggtgttgctggctcagctcttggtgcatgtttcagatatgtgtgtacacttctgactggtgatcagggcccggcccacggccctgagcggctgcagcctgctttgggacgatggtcaggtcccatgttgtccctgctgcctccctctggagtggccacttggccaaagcgcccatccacatctggaaagtcggagccgcagcctgctgcaccgtttccgctctgggatcttgtgagttacttttttaggctgtggtttggtgaaaggaaccaacacattaacgatttttcccccagaagccactgaataattctttttggtgtatttttgccttcctgttggctgtctggccttggagcaggtcgggagagtagagtacataatcagtgccacacagaggcagggcgtgtctgagagactaatgcctgtcctgcctctggcctgtgtcctgggtgtgtaccatacctgctgggccagtcccacacatttccaccctgcccctggagcagcagctttgataccatgggtgtcccttgagtctgagctagagtgtgtccccgataaactgtgagacctccctgttcttggtgaccccagttgggctttggcccctccagcaaccttgtgtcccagccctgcccttcttcccaccccctcaatctgctagtccctgaagcctttaaccaaacgggagtgggcacagaaagccttctcctggcaacaggacaagggctgcccgcgtgtccagccctgttgctctcctggcgctgagaggtgggtccaagcagagttgatcagtccctgcctgccctgcctaggtctagccaggggaggttgtgtgtgtgggagaagaccccgggatctgctggggtgggatggaggttattaaagatctaagtgaggaggggctggggtttggatgcggggtgaggcccgagcgctcacacttcgtgtagggcgggcaggggcctgacctcttgcagggcagtggccttggtgccctacccctgccctgcgcagtatttattgctaaattattgtccaggaggggcagcactgggcctggccccccgggtatttattgctgtacatagtgtatgtttgtgatatataaggttttctttattttgtatatgatcaataaaccttttaaagaga

SEQ ID NO: 419727 - DNA, 2996 bp, Homo sapiens
aaaaaaaaagaaaaaaaatccctttcttgtaaacttacggacacctctttgtggctgttggagtttagtttttatatacacagagttatcagacattattgttataaacttagtttaaaaaaaagacaaaaaaaaaaaagccaagccgtgagccgaccagaaggccgtcctctttgatatcttttgcaattgtaccgaaagtgacttactcctctgcccttcctgcttccgtctcttgccggtgccgtggtgtcgtccgtgcctggtgaggttttgtgcagcggtaaagtgctggtgcttctggtgacctttgacctgtgggtgtcacttcttgtgtctgttttcccgtgttcgttttttgggtttagttgtgcttttgcttctgctggcttgctggacctgggctggggtgccaagtggcgcctgctgcgtcagagctcaaggaatctgtgcccaccaccagctcctggtccgtaggaggtgagacatggggttctgtcatgcccccctccactgagccttggctacatctgtgtctagggcttgggctgatctagtggcggggtaggtgaaactggggtcccttggggcgccccacgctgcttccacacccaccacctctggccttgggtggtggcattacagggatgagggagtcactgtgggtggccacagggctatggccaagcgttccctggccgtcttcctctggcctcagctttgttcctataggctgcccgcgccgtgggctgcaggtctcgccgcccgcttgatccctgaggtgtttccatgctgcgggtggtgcttccaggcagagtgggtgggggcccaccgggcaccgccctttcttccttgtccctgcctcactctgagagccttgggggtctccaccagtgcagacaagggctacagtctccagggccgggtcttgtccctcttctccgctggtccacgctggcagctcttggcttcgggcctgccttctgcctccctttgggatctgtgtcttccagggatcagctgcttggcttctgctggaggtgcctccctgtgggggcgcagcctgcctcctgctctcagttcctcgccagaggctgctgcccttcctggctgggctcaggaggctccttgtaggcatatgatggggagggggtgcccctacccacctccaagaggctacagccctgtgtctggccatgtgagccctggcctttcaccgggttgctggtttcttttctgtggggcccagacttctgtaaagcacacagatgtgggtaagatgaaaaactgtggcccaacagggcttaaccctatggatggtgggatttttatccaatagtttggcctggtgtgcccacaggatgggaacagggaggcaccatcaacacttgtcatgttaatgagcttttctttgctcgaggtgttcagagacaagtcctgtgtctacctgcgtcagcctgaaaatggaaatattggctgttgactcttgtcatttagtgacttcatccccctcccctcagtctgatcttgtctaagtagaatccaggcgttagttggaatcatatcataagtatccatgaagaaaacgtcatgatctgcctcggagtggggagaaacaggccctccttgtccttgtgcagcccccacttttgtcctggctgtgggtggccatccattttgagcacctctgccaggctgcagacctggaggcgaagggagtgtggaagaggagggtgtaagggtcgacgcgtgctgaatgggaggtgcaggtcctcggtgcgttggcagaagaggcttctggagtttcgaggccatacctcctttcaagagctttggatttggggcgacttccctgggtctaggggagtgttcctgtcccctgtcaggtcagccctgcggagccactccacccctcttccccttcccctggatttcctgacatagatggtgtgttcatgtgcaggtgtgagtgtgtgcctccctctggagtggccacttggccaaagcgcccatccacatctggaaagtcggagccgcagcctgctgcaccgtttccgctctgggatcttgtgagttacttttttaggctgtggtttggtgaaaggaaccaacacattaacgatttttcccccagaagccactgaataattctttttggtgtatttttgccttcctgttggctgtctggccttggagcaggtcgggagagtagagtacataatcagtgccacacagaggcagggcgtgtctgagagactaatgcctgtcctgcctctggcctgtgtcctgggtgtgtaccatacctgctgggccagtcccacacatttccaccctgcccctggagcagcagctttgataccatgggtgtcccttgagtctgagctagagtgtgtccccgataaactgtgagacctccctgttcttggtgaccccagttgggctttggcccctccagcaaccttgtgtcccagccctgcccttcttcccaccccctcaatctgctagtccctgaagcctttaaccaaacgggagtgggcacagaaagccttctcctggcaacaggacaagggctgcccgcgtgtccagccctgttgctctcctggcgctgagaggtgggtccaagcagagttgatcagtccctgcctgccctgcctaggtctagccaggggaggttgtgtgtgtgggagaagaccccgggatctgctggggtgggatggaggttattaaagatctaagtgaggaggggctggggtttggatgcggggtgaggcccgagcgctcacacttcgtgtagggcgggcaggggcctgacctcttgcagggcagtggccttggtgccctacccctgccctgcgcagtatttattgctaaattattgtccaggaggggcagcactgggcctggccccccgggtatttattgctgtacatagtgtatgtttgtgatatataaggttttctttattttgtatatgatcaataaaccttttaaagaga

SEQ ID NO: 419728 - DNA, 3294 bp, Homo sapiens
aaaaaaaaagaaaaaaaatccctttcttgtaaacttacggacacctctttgtggctgttggagtttagtttttatatacacagagttatcagacattattgttataaacttagtttaaaaaaaagacaaaaaaaaaaaagccaagccgtgagccgaccagaaggccgtcctctttgatatcttttgcaattgtaccgaaagtgacttactcctctgcccttcctgcttccgtctcttgccggtgccgtggtgtcgtccgtgcctggtgaggttttgtgcagcggtaaagtgctggtgcttctggtgacctttgacctgtgggtgtcacttcttgtgtctgttttcccgtgttcgttttttgggtttagttgtgcttttgcttctgctggcttgctggacctgggctggggtgccaagtggcgcctgctgcgtcagagctcaaggaatctgtgcccaccaccagctcctggtccgtaggaggtgagacatggggttctgtcatgcccccctccactgagccttggctacatctgtgtctagggcttgggctgatctagtggcggggtaggtgaaactggggtcccttggggcgccccacgctgcttccacacccaccacctctggccttgggtggtggcattacagggatgagggagtcactgtgggtggccacagggctatggccaagcgttccctggccgtcttcctctggcctcagctttgttcctataggctgcccgcgccgtgggctgcaggtctcgccgcccgcttgatccctgaggtgtttccatgctgcgggtggtgcttccaggcagagtgggtgggggcccaccgggcaccgccctttcttccttgtccctgcctcactctgagagccttgggggtctccaccagtgcagacaagggctacagtctccagggccgggtcttgtccctcttctccgctggtccacgctggcagctcttggcttcgggcctgccttctgcctccctttgggatctgtgtcttccagggatcagctgcttggcttctgctggaggtgcctccctgtgggggcgcagcctgcctcctgctctcagttcctcgccagaggctgctgcccttcctggctgggctcaggaggctccttgtaggcatatgatggggagggggtgcccctacccacctccaagaggctacagccctgtgtctggccatgtgagccctggcctttcaccgggttgctggtttcttttctgtggggcccagacttctgtaaagcacacagatgtgggtaagatgaaaaactgtggcccaacagggcttaaccctatggatggtgggatttttatccaatagtttggcctggtgtgcccacaggatgggaacagggaggcaccatcaacacttgtcatgttaatgagcttttctttgctcgaggtgttcagagacaagtcctgtgtctacctgcgtcagcctgaaaatggaaatattggctgttgactcttgtcatttagtgacttcatccccctcccctcagtctgatcttgtctaagtagaatccaggcgttagttggaatcatatcataagtatccatgaagaaaacgtcatgatctgcctcggagtggggagaaacaggccctccttgtccttgtgcagcccccacttttgtcctggctgtgggtggccatccattttgagcacctctgccaggctgcagacctggaggcgaagggagtgtggaagaggagggtgtaagggtcgacgcgtgctgaatgggaggtgcaggtcctcggtgcgttggcagaagaggcttctggagtttcgaggccatacctcctttcaagagctttggatttggggcgacttccctgggtctaggggagtgttcctgtcccctgtcaggtcagccctgcggagccactccacccctcttccccttcccctggatttcctgacatagatggtgtgttcatgtgcaggtgtgagtgtgctgtccttctgatctctgttgatcccgctttcctactgagagggtggtggagagggtggtggtctcttctcacctcagtttttctgacacagcgaatcgagggctttggccaaggccaggtctctcaaacttgtccgccaagtaaaccatgatatatgtcttcccttccaccttaactttgccccaactcctcttttatcctaacatggacgctcagatttcagaggaatacccagcagggacaggtcagctctcaccaggagagtgaggcccctggctgctgctcggggtggcactggtgttgctggctcagctcttggtgcatgtttcagatatgtgtgtacacttctgactggtgatcagggcccggcccacggccctgagcggctgcagcctgctttgggacgatggtcaggtcccatgttgtccctgctgcctccctctggagtggccacttggccaaagcgcccatccacatctggaaagtcggagccgcagcctgctgcaccgtttccgctctgggatcttgtgagttacttttttaggctgtggtttggtgaaaggaaccaacacattaacgatttttcccccagaagccactgaataattctttttggtgtatttttgccttcctgttggctgtctggccttggagcaggtcgggagagtagagtacataatcagtgccacacagaggcagggcgtgtctgagagactaatgcctgtcctgcctctggcctgtgtcctgggtgtgtaccatacctgctgggccagtcccacacatttccaccctgcccctggagcagcagctttgataccatgggtgtcccttgagtctgagctagagtgtgtccccgataaactgtgagacctccctgttcttggtgaccccagttgggctttggcccctccagcaaccttgtgtcccgctgagaggtgggtccaagcagagttgatcagtccctgcctgccctgcctaggtctagccaggggaggttgtgtgtgtgggagaagaccccgggatctgctggggtgggatggaggttattaaagatctaagtgaggaggggctggggtttggatgcggggtgaggcccgagcgctcacacttcgtgtagggcgggcaggggcctgacctcttgcagggcagtggccttggtgccctacccctgccctgcgcagtatttattgctaaattattgtccaggaggggcagcactgggcctggccccccgggtatttattgctgtacatagtgtatgtttgtgatatataaggttttctttattttgtatatgatcaataaaccttttaaagaga

SEQ ID NO: 419729 - DNA, 903 bp, Homo sapiens
ccgtcacagtttctactcgggcacctagaagccagcatgctgcgctcacacagagcggcactgaccatgcgcaggaatgtctcgaccttgtccatgtccttcctgaagcagtagagcagcccgtagtccttgagcagtgcgtcatggttgtgcgagtttgtgtcaaacttgctgtaggtctgcttgaggatctgcccagatcccgtcgctctgccaaattggcagagcgtcgggagagtagagtacataatcagtgccacacagaggcagggcgtgtctgagagactaatgcctgtcctgcctctggcctgtgtcctgggtgtgtaccatacctgctgggccagtcccacacatttccaccctgcccctggagcagcagctttgataccatgggtgtcccttgagtctgagctagagtgtgtccccgataaactgggagtgggcacagaaagccttctcctggcaacaggacaagggctgcccgcgtgtccagccctgttgctctcctggcgctgagaggtgggtccaagcagagttgatcagtccctgcctgccctgcctaggtctagccaggggaggttgtgtgtgtgggagaagaccccgggatctgctggggtgggatggaggttattaaagatctaagtgaggaggggctggggtttggatgcggggtgaggcccgagcgctcacacttcgtgtagggcgggcaggggcctgacctcttgcagggcagtggccttggtgccctacccctgccctgcgcagtatttattgctaaattattgtccaggaggggcagcactgggcctggccccccgggtatttattgctgtacatagtgtatgtttgtgatatataaggttttctttattttgtatatgatcaataaaccttttaaagaga

SEQ ID NO: 419730 - DNA, 1159 bp, Homo sapiens
gcctactactactaaattcgcggccgcgtcgacatttcccaaaccccttgagtcttttcttttccttggtatttatggaattcttacaaagaaaaatttgcagaagtactattttcgtgaataaaacatatgtatcattctactaccattagcaaataacttagttgtagttaatataattgttaaaaggtttagctctgttacaaataaaaacataaagatctggcaaccagactttcatgatgttacattaccatgacaagaaactctgggcagtaaaagttggacccacatggagtacataagcatctgatacctggagatgtatttaaaatttttcaagttatcttccatgatttaggaaccatttagagacatgaagtctttatgggttgggggaaaggttgataattagtttgattaaaggtaatgattaatatccctttttgttcatacttccttctgaggctgttttcccctaaacagtatcttaatctgttacatgtaattgaaatattatttgaagcagtgagttattgtaacctcagattagttacattgatcaaaacattgatttatacacacacacacacacatacatatgtagcttttatatttagtctggttacattagtgaccatggtatttactttcttcttaaggagcctttgaatttcttgtccagataaaaatccgaatatttctcttagactcatacataaagggacacagttatcgttaggtagcatatgttttactatcggtttgtcaaaaaagttaataaaaagtgcttattgatttatttctctagaaatttgctttgtcttttttagcattaaaaataattactatagcaaagcagtcaaagttaggtatattatatatatacttggtaactaaagatgggaaacctaaaatgctatttttctttcatagcacatttactagtataaaggaagtaagatcctaataaactgagcctttatttaacttctttgacctagttttaggtttacagaaaagttgtaaaaatacaacagttctttatgtcttatattaatcttaatgttaaaatcttacgttatcatagaacatttataaaacttaagaaattaacctttgtataatactattaactaaagtagaacattttattttt

SEQ ID NO: 419731 - DNA, 2098 bp, Homo sapiens
agcggcgtgaaacgcaacggatcgtttccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgacacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgtt

SEQ ID NO: 419732 - DNA, 2531 bp, Homo sapiens
agcggcgtgaaacgcaacggatcgtttccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgacacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgttttggagtttttttttaaagtcatgaagagcttcacaattctagtgatacaatgttgactatatattgtactttatattaaatataggtaatacagaattagatcgtttggataggttttgagttagtgcagaactcaagaagaaaaattaggaaatattctgaaggccagaactctggaagaacttagaaagtttgggaataaattaaacttatgtagatttaaaattaaaaggggtttatttcccaaaccccttgagtcttttcttttccttggtatttatggaattcttacaaagaaaaatttgcagaagtactattttcgtgaataaaacatatgtatcattctactaccattagcaaataacttagttgtagttaatataattgttaaaaggtttagctctgttacaaataaaaacataaagatctggc

SEQ ID NO: 419733 - DNA, 1041 bp, Homo sapiens
agcggcgtgaaacgcaacggatcgtttccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagagcctccatctacagcagcaatggggcccggatcttccagacaaaccctggatatatatataggtctgcagctcattttaccctttatagggataagaaatcaccatcactctagaacttccagaattgcttattagatttctcatattatttgacaatacttacatggagtttactgtacacataagtcatgcagtaactgtatttttattgagagtattaatcccttggtttcaacattgtttttgaaattagtaactaagtaagtacttgaatatgattggatgggatctcatactcaaaaggctgaaagcatcttaatatgactttctcaaaggaacctaaaacttaaccaagtccaaaagggaatcatttttcattttttaacagaatggcgtgggatgga

SEQ ID NO: 419734 - DNA, 1365 bp, Homo sapiens
ttttttttttgtattttaaccattctagtgtgtgtatagtgttttgtcatggttttgatttgtacttccctaatgatgactgcttttttgtatgtttattagccatttgtatatcctcttgtgaagtgtgcagaatcttttacctatctctaatgtctcttgcttaccagtttgtaagaattctttatatattttagctgtgactcttatcagaaattctatgctttttcactgtcttaatgacgactttgataaactttttatcaaattgctttttaacaaaatccaatttgtccatcattttgtttatgactagtgctttccatgttctatttaagaaatcgttgcttacttcagggctgtgagtgttttctcatatggaggcacatttaaatatgtaaatgacctggaactgattattgtataaggtgtgacatggatgtaattaaagaactttaaacaaaagggtgatagtaatttgataattagtagaaaatagaagtcgaaggctgagaaatagtagaaacctgttagtatagtctgattgcttaaaatctgctagcttatgaggaagattaacaaattaatatattcaagtcaaattgatgagatttcattatagactgcctatgggtggagggagaggagatgctgaagaggaacgaatggattttgctttgagaaactgagtctgtacggtgcatcaaataatatggggaaaagaatggactgtgggggcaatagcattaagtttagtagatgctaacatactgagttttatgttcttgtgaaatatcttaaggagaaatacacatctaatacttactttggatttataaaagataaacacagaattttattttctgtttgtaggtagtgctataaatacaaaaatagaaaatatactactggctacatccatgttttattaacataattttttgtgaattcatctgtagagcctccatctacagcagcaatggggcccggatcttccagacaaaccctggatatatatataggtctgcagctcattttaccctttatagggataagaaatcaccatcactctagaacttccagaattgcttattagatttctcatattatttgacaatacttacatggagtttactgtacacataagtcatgcagtaactgtatttttattgagagtattaatcccttggtttcaacattgtttttgaaattagtaactaagtaagtacttgaatatgattggatgggatctcatactcaaaaggctgaaagcatcttaatatgactttctcaaaggaacctaaaacttaaccaagtccaaaagggaatcatttttcattttttaacagaatggcgtgggatgga

SEQ ID NO: 419735 - DNA, 385 bp, Homo sapiens
agcggcgtgaaacgcaacggatcgtttccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgaagcttgcacataccaccgaggtgtgcgggggctcacacctgtaatcccagaactttgggaggccaaggagggaggattgcattgagctgagtccaagaccagcctgggcaatatagtgagaccccatctctaccaaaaaattaaaaaaatagctggcgcggtgaacctattctggac

SEQ ID NO: 419736 - DNA, 226 bp, Homo sapiens
ttttttgccagatctttatgtttttatttgtaacagagctaaaccttttaacaattatattaactacaactaagttatttactattttcgtgaataaaacacaagtactattttcgtgaataaaacatatgtatcattctactaccattagcaaataacttagttgtagttaatataattgttaaaaggtttagctctgttacaaataaaaacataaagatctggc

SEQ ID NO: 419737 - DNA, 3463 bp, Homo sapiens
agcggcgtgaaacgcaacggatcgtttccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgacacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgttttggagtttttttttaaagtcatgaagagcttcacaattctagtgatacaatgttgactatatattgtactttatattaaatataggtaatacagaattagatcgtttggataggttttgagttagtgcagaactcaagaagaaaaattaggaaatattctgaaggccagaactctggaagaacttagaaagtttgggaataaattaaacttatgtagatttaaaattaaaaggggtttatttcccaaaccccttgagtcttttcttttccttggtatttatggaattcttacaaagaaaaatttgcagaagtactattttcgtgaataaaacatatgtatcattctactaccattagcaaataacttagttgtagttaatataattgttaaaaggtttagctctgttacaaataaaaacataaagatctggcaaccagactttcatgatgttacattaccatgacaagaaactctgggcagtaaaagttggacccacatggagtacataagcatctgatacctggagatgtatttaaaatttttcaagttatcttccatgatttaggaaccatttagagacatgaagtctttatgggttgggggaaaggttgataattagtttgattaaaggtaatgattaatatccctttttgttcatacttccttctgaggctgttttcccctaaacagtatcttaatctgttacatgtaattgaaatattatttgaagcagtgagttattgtaacctcagattagttacattgatcaaaacattgatttatacacacacacacacacatacatatgtagcttttatatttagtctggttacattagtgaccatggtatttactttcttcttaaggagcctttgaatttcttgtccagataaaaatccgaatatttctcttagactcatacataaagggacacagttatcgttaggtagcatatgttttactatcggtttgtcaaaaaagttaataaaaagtgcttattgatttatttctctagaaatttgctttgtcttttttagcattaaaaataattactatagcaaagcagtcaaagttaggtatattatatatatacttggtaactaaagatgggaaacctaaaatgctatttttctttcatagcacatttactagtataaaggaagtaagatcctaataaactgagcctttatttaacttctttgacctagttttaggtttacagaaaagttgtaaaaatacaacagttctttatgtcttatattaatcttaatgttaaaatcttacgttatcatagaacatttataaaacttaagaaattaacctttgtataatactattaactaaagtagaacattttattttt

SEQ ID NO: 419738 - DNA, 3058 bp, Homo sapiens
cctcaaaagaagaagaaatgtgtcatatatcaatttggggatataagcaaatcctagtcacagtcgttttctaaaaagtattgttttctggaaaaacctagtttttaagaatgatgccacagcgaagttctattttaactttttaatttgatttttttttctttgttacagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgacacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgttttggagtttttttttaaagtcatgaagagcttcacaattctagtgatacaatgttgactatatattgtactttatattaaatataggtaatacagaattagatcgtttggataggttttgagttagtgcagaactcaagaagaaaaattaggaaatattctgaaggccagaactctggaagaacttagaaagtttgggaataaattaaacttatgtagatttaaaattaaaaggggtttatttcccaaaccccttgagtcttttcttttccttggtatttatggaattcttacaaagaaaaatttgcagaagtactattttcgtgaataaaacatatgtatcattctactaccattagcaaataacttagttgtagttaatataattgttaaaaggtttagctctgttacaaataaaaacataaagatctggcaaccagactttcatgatgttacattaccatgacaagaaactctgggcagtaaaagttggacccacatggagtacataagcatctgatacctggagatgtatttaaaatttttcaagttatcttccatgatttaggaaccatttagagacatgaagtctttatgggttgggggaaaggttgataattagtttgattaaaggtaatgattaatatccctttttgttcatacttccttctgaggctgttttcccctaaacagtatcttaatctgttacatgtaattgaaatattatttgaagcagtgagttattgtaacctcagattagttacattgatcaaaacattgatttatacacacacacacacacatacatatgtagcttttatatttagtctggttacattagtgaccatggtatttactttcttcttaaggagcctttgaatttcttgtccagataaaaatccgaatatttctcttagactcatacataaagggacacagttatcgttaggtagcatatgttttactatcggtttgtcaaaaaagttaataaaaagtgcttattgatttatttctctagaaatttgctttgtcttttttagcattaaaaataattactatagcaaagcagtcaaagttaggtatattatatatatacttggtaactaaagatgggaaacctaaaatgctatttttctttcatagcacatttactagtataaaggaagtaagatcctaataaactgagcctttatttaacttctttgacctagttttaggtttacagaaaagttgtaaaaatacaacagttctttatgtcttatattaatcttaatgttaaaatcttacgttatcatagaacatttataaaacttaagaaattaacctttgtataatactattaactaaagtagaacattttattttt

SEQ ID NO: 419739 - DNA, 2735 bp, Homo sapiens
tgatttataaagaaaaagaggtttaatgaactcacagttccatatggctggggaggcctcacaatcatggcagaaggtagagcgagtaataaaggaatgttttacatggtggcaggcaagaaaaaaaccatcagaacttctgagacttattcactatcatgagaacagcatgggaaaaaggcatccccatgatccagttacctcccactaggtccgtcacacaccatgtggagattatgggagctagaattcaagatgagatttggttggtgacacagggaaaccatatcagtgaccgactaatattttttattattttgcggagacagggttccactttgttgcccaggcttcaagcagtcctcttgcctcagcctcccaaagtgttgggattatgggcataagcgaccatgccttgcctatgtacttttaaaatgcctcttttgtcagttttttcatcgaggatatagaatgaatagcctacgatttttatttttattgctgtgtttattaatatgtttaatacttatttattgagtggacttaaattatgtatacaacacttagccattatgaaatgttagaagatgttgttttttaaaccctactgaaattgccttgcaatacgatcatatctgaatttacagatccatatgccagtgtccacataaattatctccactggtagaagtgagtatggattcacttagaacttacttatatttcatgtttattatgtgctcagcattgagcttgggcatgggatgtaaaagtacattatggtcccttcctcagcattactcatcttgaaaaccttggattcctagtctttattcctttctcgttagtgcaactgattaatacttaaatatgctgacaatagcgtgattatttgagacttactattctaatataaggagcttttctgttaagacagaatgtagatacattgtaacaattatttataaaataccttttaaccttttaatgggaatcatttgatacacaaagcatttggcttctcagaaagcttttaaggttattaatttggagtacaaagaaatattttggtatattaataatggtaataaggtttcaaaattctccagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgacacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgtt

SEQ ID NO: 419740 - DNA, 1279 bp, Homo sapiens
agcggcgtgaaacgcaacggatcgtttccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggtaacttatgcatgacttattaaaatagtttatggtagaatttagaaagttaaacctttctgtctttaaacattgtttgccatgcagtgttattaggcattttacttacattgccattaacatcttcacaatagcctacacaaacacaggggtttgtatgttgtgtgtttatacatgagaaaacagaaacaaggttacagttcttaagtggtcattgtgatataaactgcctgtttttcttcatattctgtatttaaaagtgatgctatttgggctaaatgttttgtttgaaggactgtcctacacattgcagggcatttagaattttgggccctggggcactaagacaacattatcccaagacgacccatacttttccgcatcctgcagttgagagcctctcttctgtattatgctctagtttatagaaatgcagcactgtgtaaaaatcttccactctgtttccacattcttcctgatatactgtacattcatttttagtaacttagacacttgtaaaatgctagagtttgtacacttactggcttattaaaaatcagatttatccctaaa

SEQ ID NO: 419741 - DNA, 724 bp, Homo sapiens
ggtcaccaatactgcaaatatgtatgagatgtaactgtaagatacgcagctaattttttttctctttgtttcctttttagacataccagggtctagagagtctagaagaagtctgtgtatatcattctggagtacctattttccatgaggggtaacttatgcatgacttattaaaatagtttatggtagaatttagaaagttaaacctttctgtctttaaacattgtttgccatgcagtgttattaggcattttacttacattgccattaacatcttcacaatagcctacacaaacacaggggtttgtatgttgtgtgtttatacatgagaaaacagaaacaaggttacagttcttaagtggtcattgtgatataaactgcctgtttttcttcatattctgtatttaaaagtgatgctatttgggctaaatgttttgtttgaaggactgtcctacacattgcagggcatttagaattttgggccctggggcactaagacaacattatcccaagacgacccatacttttccgcatcctgcagttgagagcctctcttctgtattatgctctagtttatagaaatgcagcactgtgtaaaaatcttccactctgtttccacattcttcctgatatactgtacattcatttttagtaacttagacacttgtaaaatgctagagtttgtacacttactggcttattaaaaatcagatttatccctaaa

SEQ ID NO: 419742 - DNA, 2041 bp, Homo sapiens
agcggcgtgaaacgcaacggatcgtttccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgacacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgtt

SEQ ID NO: 419743 - DNA, 648 bp, Homo sapiens
agcggcgtgaaacgcaacggatcgtttccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaaggtatactttatacagttacatatttttgtcacacttgaatagtagcacttgtgcatggtactttcctttatgatttagcatgataccatttgtagctactatgtaggccaccaagctttgaaccatttggtttctcccttaaatctgccttaaatttttatttctcttcaacttga

SEQ ID NO: 419744 - DNA, 2044 bp, Homo sapiens
agcggcgtgaaacgcaacggatcgtttccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgacacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgattttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgtt

SEQ ID NO: 419745 - DNA, 2045 bp, Homo sapiens
gctatcggaagataccttgtcattgctggaaacgatcgccccttcacgacaagtgtacgaagaatctctgcgtccgtgtgcgcctgctgtggagtgggaaaagaaatggctgtgtgctacggggctgggcacgcttcatcctgaacaatccgagatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgacacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgtt

SEQ ID NO: 419746 - DNA, 2199 bp, Homo sapiens
aatcagagcccgtgctctccctagtgccggccaatgggaggtgcgctcgggctgcttccggctccgcgctccgctcgccccctcccaaggtctccccgcgactggcgggacgcaggggcgggcgtcggccgcggtgacgcgcagcgggcctggagccaataaggggcgggctcggtgctgatggacggtgctggtggccagtggagaggcgctggccgcacttcccgtcggggagagagtgtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcactctcgccagagatatcaaagcaaaaatggacaaaaaattggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggaataagttaaaaatttgctatttttcctgtaacatctgctgaacgggcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaatagtctgctctccccgggaatctctaacatgctctgtttacatcgataaatgcacttaaggaaaacaaacaaattaaagctcatcttaaagtcca

SEQ ID NO: 419747 - DNA, 2798 bp, Homo sapiens
aatcagagcccgtgctctccctagtgccggccaatgggaggtgcgctcgggctgcttccggctccgcgctccgctcgccccctcccaaggtctccccgcgactggcgggacgcaggggcgggcgtcggccgcggtgacgcgcagcgggcctggagccaataaggggcgggctcggtgctgatggacggtgctggtggccagtggagaggcgctggccgcacttcccgtcggggagagagtgtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcactctcgccagagatatcaaagcaaaaatggacaaaaaattggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggaataagttaaaaatttgctatttttcctgtaacatctgctgaacgggcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaatagtctgctctccccgggaatctctaacatgctctgtttacatcgataaatgcacttaaggaaaacaaacaaattaaagctcatcttaaagtccaaggatttttatgtccacattttccctgtaggccacacggacatggccaggtgctgggggtgggtctggacaagatggtagagcccatggattaccccatcgagcggccacctcagaggagatgccacccatcatcaaaagactaaattgggaaaagaagcctcctggcttggtgcagtggctcacacctgtaatcccagcactctgggaggccaaggcgggctgatcacttgagctcaggtgttcgagaccagcctggccaacatggtgagcctgcgtcacctggcttctggcacacagctcggccactgtgtccctcctgcctccctggcaggtccttctaggggccctctcctggctggctttccagggcattccttccactctatccagggtccttcccaagaccacacccaggtccagtcattccctaggacttggcagagagctgtactcacagccaagatcacagcaaaatcagcaaagggaaaaggcatgcagagtgaagtccagaggcaaccagacagaagcatccagaatcctctcacagtggggtcacacaccccatgcttaactcccccaacaatgagttgtaacaac

SEQ ID NO: 419748 - DNA, 1004 bp, Homo sapiens
  misc_feature (859)..(859): n is a, c, g, or t
  misc_feature (871)..(871): n is a, c, g, or t
ttagctaggtacgagcctgggttataatcggccgagggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcactctcgccagagatatcaaagcaaaaatggacaaaaaattggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggattgcnttttcccgtccnttggggacggcccccccgtgtttcagggggccgggccggttggcggcgccccgttggctccctgcctgttgggctccagcccggggcgccccgcaggccagccgggggggccccggaggggaacagggggcct

SEQ ID NO: 419749 - DNA, 569 bp, Homo sapiens
tcatgcactacagattggaaaaataaaaattctcgagctaagaacgtccgatttggagatagcgggaggacacgaaggagtgggggccattttggtgctgagaggagggtgccccaacttcaggaggaccatgtgacggctgtggttgttttcggggtcacttgtcagcacacactgcgtccccttgatgctctatggggaccgcatactggcctgcgaacctctgaggttccctagcgcgattctgtcttcgtcttcctatgtcttacctgtgtgatattgttctccagtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaata

SEQ ID NO: 419750 - DNA, 2106 bp, Homo sapiens
aatcagagcccgtgctctccctagtgccggccaatgggaggtgcgctcgggctgcttccggctccgcgctccgctcgccccctcccaaggtctccccgcgactggcgggacgcaggggcgggcgtcggccgcggtgacgcgcagcgggcctggagccaataaggggcgggctcggtgctgatggacggtgctggtggccagtggagaggcgctggccgcacttcccgtcggggagagagtgtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcactctcgccagagatatcaaagcaaaaatggacaaaaaattggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggaataagttaaaaatttgctatttttcctgtaacatctgctgaacgggcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaata

SEQ ID NO: 419751 - DNA, 1885 bp, Homo sapiens
gctggtacggtccggaagcgttgggaggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcactctcgccagagatatcaaagcaaaaatggacaaaaaattggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggaataagttaaaaatttgctatttttcctgtaacatctgctgaacgggcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaata

SEQ ID NO: 419752 - DNA, 1763 bp, Homo sapiens
  misc_feature (1694)..(1694): n is a, c, g, or t
  misc_feature (1706)..(1706): n is a, c, g, or t
  misc_feature (1708)..(1708): n is a, c, g, or t
  misc_feature (1721)..(1721): n is a, c, g, or t
  misc_feature (1737)..(1737): n is a, c, g, or t
  misc_feature (1754)..(1754): n is a, c, g, or t
aatcagagcccgtgctctccctagtgccggccaatgggaggtgcgctcgggctgcttccggctccgcgctccgctcgccccctcccaaggtctccccgcgactggcgggacgcaggggcgggcgtcggccgcggtgacgcgcagcgggcctggagccaataaggggcgggctcggtgctgatggacggtgctggtggccagtggagaggcgctggccgcacttcccgtcggggagagagtgtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcactctcgccagagatatcaaagcaaaaatggacaaaaaattggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggaataagttaaaaatttgctatttttcctgtaacatctgctgaacgggcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtccgtcaggcctcccagacccaatcacgcgggggttttttttgtgttgaaaaggancaacaaaaaaancnaaccccctccccntcccaacaaaaatacncccccaaaaaaacctangtagtaagg

SEQ ID NO: 419753 - DNA, 1525 bp, Homo sapiens
aatcagagcccgtgctctccctagtgccggccaatgggaggtgcgctcgggctgcttccggctccgcgctccgctcgccccctcccaaggtctccccgcgactggcgggacgcaggggcgggcgtcggccgcggtgacgcgcagcgggcctggagccaataaggggcgggctcggtgctgatggacggtgctggtggccagtggagaggcgctggccgcacttcccgtcggggagagagtgtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcactctcgccagagatatcaaagcaaaaatggacaaaaaattggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggaataagttaaaaatttgctatttttcctgtaacatctgctgaacgggcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttctttttttttttttcctccttaagctgctgtcaatccaaaccattggcatcatcgtttcttttgaattaaaaccaacatatcagcaata

SEQ ID NO: 419754 - DNA, 1228 bp, Homo sapiens
aatcagagcccgtgctctccctagtgccggccaatgggaggtgcgctcgggctgcttccggctccgcgctccgctcgccccctcccaaggtctccccgcgactggcgggacgcaggggcgggcgtcggccgcggtgacgcgcagcgggcctggagccaataaggggcgggctcggtgctgatggacggtgctggtggccagtggagaggcgctggccgcacttcccgtcggggagagagtgtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcactctcgccagagatatcaaagcaaaaatggacaaaaaattggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggaataagttaaaaatttgctatttttcctgtaacatctgctgaacggcaccgtgtttttccgaagcgacggggggtcccgggtgccgtcgaccagccggtcggccttgctctgggctttgttgggcttctggaccaagtccccggggggtggtccgtcccacccg

SEQ ID NO: 419755 - DNA, 1215 bp, Homo sapiens
  misc_feature (1070)..(1070): n is a, c, g, or t
  misc_feature (1082)..(1082): n is a, c, g, or t
aatcagagcccgtgctctccctagtgccggccaatgggaggtgcgctcgggctgcttccggctccgcgctccgctcgccccctcccaaggtctccccgcgactggcgggacgcaggggcgggcgtcggccgcggtgacgcgcagcgggcctggagccaataaggggcgggctcggtgctgatggacggtgctggtggccagtggagaggcgctggccgcacttcccgtcggggagagagtgtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcactctcgccagagatatcaaagcaaaaatggacaaaaaattggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggattgcnttttcccgtccnttggggacggcccccccgtgtttcagggggccgggccggttggcggcgccccgttggctccctgcctgttgggctccagcccggggcgccccgcaggccagccgggggggccccggaggggaacagggggcct

SEQ ID NO: 419756 - DNA, 1773 bp, Homo sapiens
  misc_feature (17)..(17): n is a, c, g, or t
gtcaggtaggtacaggncgcgtggctaatcggccgaggattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcactctcgccagagatatcaaagcaaaaatggacaaaaaattggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggaataagttaaaaatttgctatttttcctgtaacatctgctgaacgggcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaata

SEQ ID NO: 419757 - DNA, 1692 bp, Homo sapiens
ctggttttctatgctcgccagaaatctcttttctaggagttagccagtgaacccacgcgtccgcaggggtgcaactgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcactctcgccagagatatcaaagcaaaaatggacaaaaaattggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggaataagttaaaaatttgctatttttcctgtaacatctgctgaacgggcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaata

SEQ ID NO: 419758 - DNA, 1672 bp, Homo sapiens
ggtcgatctgaagaggatccccgagcggcttcaacggcctactacaggagtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcactctcgccagagatatcaaagcaaaaatggacaaaaaattggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggaataagttaaaaatttgctatttttcctgtaacatctgctgaacgggcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaata

SEQ ID NO: 419759 - DNA, 1354 bp, Homo sapiens
aatcgagctggataccccccgactgaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggaataagttaaaaatttgctatttttcctgtaacatctgctgaacgggcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaata

SEQ ID NO: 419760 - DNA, 1317 bp, Homo sapiens
cagtaggctagtagaggcccggtgttaatcggcaccgagggcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggaataagttaaaaatttgctatttttcctgtaacatctgctgaacgggcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaata

SEQ ID NO: 419761 - DNA, 1247 bp, Homo sapiens
  misc_feature (6)..(6): n is a, c, g, or t
tgatanaatcagctcgtaccagcagcatgatttaccgtcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggaataagttaaaaatttgctatttttcctgtaacatctgctgaacgggcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaata

SEQ ID NO: 419762 - DNA, 1018 bp, Homo sapiens
  misc_feature (19)..(19): n is a, c, g, or t
actcgagctcggtaccggnatagcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaata

SEQ ID NO: 419763 - DNA, 1062 bp, Homo sapiens
tctggaccccattcttggtttcctatgctgtttctctcccctttttgcagtttttttcccctaaacgcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaata

SEQ ID NO: 419764 - DNA, 895 bp, Homo sapiens
taggctaggtacgaggcctgggtggtgggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaata

SEQ ID NO: 419765 - DNA, 1021 bp, Homo sapiens
aatcagagcccgtgctctccctagtgccggccaatgggaggtgcgctcgggctgcttccggctccgcgctccgctcgccccctcccaaggtctccccgcgactggcgggacgcaggggcgggcgtcggccgcggtgacgcgcagcgggcctggagccaataaggggcgggctcggtgctgatggacggtgctggtggccagtggagaggcgctggccgcacttcccgtcggggagagagtgtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcactctcgccagagatatcaaagcaaaaatggacaaaaaattggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctccgggccattcaacgcctccgctggccattcaacgcctccgggccattcaacgcctccggccattcaacg

SEQ ID NO: 419766 - DNA, 858 bp, Homo sapiens
ggctcggtacccgggcagtacggatgtgcgggccagtaagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaata

SEQ ID NO: 419767 - DNA, 950 bp, Homo sapiens
  misc_feature (903)..(903): n is a, c, g, or t
  misc_feature (919)..(919): n is a, c, g, or t
  misc_feature (929)..(929): n is a, c, g, or t
aatcagagcccgtgctctccctagtgccggccaatgggaggtgcgctcgggctgcttccggctccgcgctccgctcgccccctcccaaggtctccccgcgactggcgggacgcaggggcgggcgtcggccgcggtgacgcgcagcgggcctggagccaataaggggcgggctcggtgctgatggacggtgctggtggccagtggagaggcgctggccgcacttcccgtcggggagagagtgtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcactctcgccagagatatcaaagcaaaaatggacaaaaaattggtccacagccaggggttaggtctgcaggcccgtctgcggtccccatcgagcatcaaggggacgctgtgtgtgctgcaagtgaccccgaaaacaaccacagccgtcacatggtcaacgccccgcccangccgcgggcaacgggnccacgggcancaaaatgcaatttagaaatcg

SEQ ID NO: 419768 - DNA, 921 bp, Homo sapiens
  misc_feature (735)..(735): n is a, c, g, or t
aatcagagcccgtgctctccctagtgccggccaatgggaggtgcgctcgggctgcttccggctccgcgctccgctcgccccctcccaaggtctccccgcgactggcgggacgcaggggcgggcgtcggccgcggtgacgcgcagcgggcctggagccaataaggggcgggctcggtgctgatggacggtgctggtggccagtggagaggcgctggccgcacttcccgtcggggagagagtgtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcnctctcgccagagatatcaaagctgaatttagccaaaaaagccgaagaaatggagcaacctgaaaagaaagtaatgccaaacagtccccagaatggtgtgctggttaaggaaactgctatagaaaccaaagttaccgtcttcgaagaagagattcttgcagcaaccagaggaatgaatggagactct

SEQ ID NO: 419769 - DNA, 892 bp, Homo sapiens
  misc_feature (735)..(735): n is a, c, g, or t
aatcagagcccgtgctctccctagtgccggccaatgggaggtgcgctcgggctgcttccggctccgcgctccgctcgccccctcccaaggtctccccgcgactggcgggacgcaggggcgggcgtcggccgcggtgacgcgcagcgggcctggagccaataaggggcgggctcggtgctgatggacggtgctggtggccagtggagaggcgctggccgcacttcccgtcggggagagagtgtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcnctctcgccagagatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtagg

SEQ ID NO: 419770 - DNA, 691 bp, Homo sapiens
gcatgcatcggcttggaaagggatggatgagtggatggttcttggttggaagggatggatggttggttgattggtttgttggttggaagcaggtggatagacggatggaagggaatgggtgagtggatggatggatggttgaaagggtatagatggatggttggttggttggttggttggttggttggttggttggttggttggatggttggaaggggacagctggacggactggcagatgatggatggatggtttgatggctgattggttggttggatggctggaatggtaatggatggatgacctggcagatgatggatggatggttggatggctcgttggttagttggttggtttggctggtttgattggtttggttgtttggttggttggttggttggttggttggatggttggatggatggttaggtggatggttaggtggatggctggttgattgtgagacgtagtgctgattctcagtgataacctcagaaaacctcttgtgatttcaggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccct

SEQ ID NO: 419771 - DNA, 1721 bp, Homo sapiens
cactgtcctccattgtaagataaaaagagctacctaagagatctgtggctcagttccttttgttcagtatatatacctcagggtaaaggacctaaggctctggcacttcctacataatttgttcataaaaataattttctgtacctgtaggtgcagggattcatagtgatttttctgttttaaaaaatatctttctacactgtctgatttttaaaaatgagattatcagtataaaagaaatacagctattttgtaaaagaaaaatacaggagaaaaaggataaagctactttgttttaaaacgcagtatcattaaaacaaaaacaaaccaaatttgttctaagtttgactttagagtcaggaaacttaagcttacatttttggtctgccatctattacttttaaagcttgggcaaattattcatttgaagtctaagtttattaatctgttaatgggaacagattagaaatcttcagagaagctctagcctttgtaacattgtgactataatgctgagaactgcttcactcatcccattcatattttaaaaatactaatattttgtgtttgagcattttaataggctcagaaacttaaaaatgatgtttcttttctaacaacatactcttttcaatgggatattatggttgttattatttaacatgacatttagggactcaacatacattaaggtgatggcactaagataaatgtagaaataaccagtaccatgtaattttcataagtgcttaaattgttggtaaacaattttatgagttggaggtgttgaagcaaatattattaatatttgaacataaaagctgatcaaaggggcctggtccacagaagatgtttatttgatgtaacaaaacaatacagttagtgttagatccaaccacaaagagcaaaaggaatgaaaaatttgtacaatgtacatagaaaaaacaagatatttactgtgacaactatatattcctaaaataatgcttctaaaattactcaattattgaaatctacatgaaaaaaaggatgttaatagcgacaaagtgcataaaatcaaacattgtattttgagcaaattaacatactaggcaattttgctaagaatgcatgattttttttttcttgtttacagtctgctcaaaatatctttataccaacagggtaggcagaacatttaggtttaatatcagttacacaatattagcataaacttccacaactacatagggtattgttttcttttgagctggcaaagtgactatagaaacatcagatgatttctctgaattgagaattttatccaaataaatgccacataccttctagatatatgcatatctttctatattatgtaaatggctttacccatttaaataataaaccatacagcatttaagaatcattattatatgattaacaatgtcatgttccaggtttaacaatttcataggccaaaaaaaatttcttcttaaaaactagttttataaacgcagaatatattccatgagtaactgctggtattttttaagaaaatatattgtgcaattgtggctaccacgtactgctggcaaagcattattatttatgtaaaatgtgaaaaaaaaggtgtaaaaatttttcaactgcctatgatcatgatgaaaggttactgccttcttacaaaaattatattggcatcttcttaaaaataattcgaaaaagggataaactccctagcc

SEQ ID NO: 419772 - DNA, 2182 bp, Homo sapiens
gcgcctaggtacgggctgagtatcaatcggccgaggccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419773 - DNA, 708 bp, Homo sapiens
attttaaacgacttcactaaaggggatttggccctcaagggccaaaattcggcccgagccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419774 - DNA, 1002 bp, Homo sapiens
cgggcgataggccaagtgcggggacgccgggggggccttcacgggaggcccgggctcttccgggcgtcgcggagccggagggtgcaggcgacgggaagcgcgggtggtcggctggggtccggctcctggagaacatggcccggcctcccgggggctctggtcccctcctcgttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatggttgtctacatggggatcactaaaaatttgatgagggaaattggaaacgttttaaaatgacttggcagttggtaaccagaagatcttatagttgggcccaagaacttcggggaaaagagtttccaggatttataaagcttgaggaagttcacgagtataaaaaaca

SEQ ID NO: 419775 - DNA, 1033 bp, Homo sapiens
cgggcgataggccaagtgcggggacgccgggggggccttcacgggaggcccgggctcttccgggcgtcgcggagccggagggtgcaggcgacgggaagcgcgggtggtcggctggggtccggctcctggagaacatggcccggcctcccgggggctctggtcccctcctcgattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaactagcagatgtattcgggcggcgcccatgggaggaaagagctccgacagagagtgacgctgtttgggcggaggcagccttgcaagcacccgagggatacgtggaaagagtgcagggttcgctatcaatttttttgttttccggtgacatagttatacagaac

SEQ ID NO: 419776 - DNA, 318 bp, Homo sapiens
  misc_feature (35)..(35): n is a, c, g, or t
gagagagagagagagagagagagagagagagaganagagagagagagagagagagagagagagagagagagagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419777 - DNA, 768 bp, Homo sapiens
tgtaaaaataagtctttaattaattcattgttttgttttcctttttcagttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcaggtaagtactgcaagcaaaacacagacatcttatgattgctcatacatgtggatggttcctgctctcaagttgcccgtagtctgagagtggcagagagagacaaaaatataaagcactgtgctatattggtgaagttctgggagaaacatactcatatataggatgccaggaattcatggaggagaacatttagaatattgcttctcaaactttaatgcgctttggaatacctggggaccttattaaaatgcagattctgatttagtaactgtagaatggaccgtgaacttcttcatactcctgcataataccaatgttgctggtctgtgagccatgttataagttacaaagatacagagtagttcggtgatcagtgcacacctgcagcatgccatgcactgacctagaaattaggatataaaaatattgggatatttcttgtcttcaaggagtccatacatagagggagacgatgaataaaaagatactca

SEQ ID NO: 419778 - DNA, 307 bp, Homo sapiens
tgtaaaaataagtctttaattaattcattgttttgttttcctttttcagttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcaggtaagtacaaaagtccggggagatttcgtg

SEQ ID NO: 419779 - DNA, 307 bp, Homo sapiens
cttatgcttaacgggtaagtttcacttttcttaggagaaaaacaaaacccactgtttaatgcaggacgaatgaaatgtttttaaatccttatttttcccttttcctttgtagacaatactgtcagagttcaagacacagattggaaagaagtaggtatttttaaatattaagactaatgtccataacacagaaatgactagtgaattaatatattaagggtatattttcacttttatatgatgtagtgaaatctgttttaatttattgctaaatttcagtaaatgaaaatgttttcaacttttaaaa

SEQ ID NO: 419780 - DNA, 1917 bp, Homo sapiens
cgggcgataggccaagtgcggggacgccgggggggccttcacgggaggcccgggctcttccgggcgtcgcggagccggagggtgcaggcgacgggaagcgcgggtggtcggctggggtccggctcctggagaacatggcccggcctcccgggggctctggtcccctcctcgttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419781 - DNA, 1908 bp, Homo sapiens
tgaagaggagtcagtcatttgaagatctggaagaacaaacggagaggcccgaaggctgcaatgaagttgatctgctttttggaacggatggaaagctcatgtgaatagagaacagtgagagaggatggatggcacaggatgcagtaggagaaatgggaagagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419782 - DNA, 1970 bp, Homo sapiens
catcgagttccgcatcctgaaagcatggagccaaagacaaagatgactgaaagaactttagactaaaatcttccagttacattgtcttactctcttttacttctcagacacttcccccaccctcatagaacctgttgcatgcaacttagtttcacagctttgcctcttctttttgatgtatttattccagacctttctgccacgattggaatgacgacagtatgttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419783 - DNA, 1928 bp, Homo sapiens
gtgaaatgttgcttttttgctaaaactgaggcaaacgttgatcttgagagcttgcagtttgggggcagtaaagttgagaaaggatcatattctgttattggtttgtgggactgcaggtgaagctgctttgtttccctaaaagatactttttggggacaataatttgggagtaaagcggcaagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419784 - DNA, 2144 bp, Homo sapiens
gcgcctaggtacgggctgagtatcaatcggccgaggccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagctgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419785 - DNA, 2030 bp, Homo sapiens
gcgcctaggtacgggctgagtatcaatcggccgaggccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419786 - DNA, 1765 bp, Homo sapiens
cgggcgataggccaagtgcggggacgccgggggggccttcacgggaggcccgggctcttccgggcgtcgcggagccggagggtgcaggcgacgggaagcgcgggtggtcggctggggtccggctcctggagaacatggcccggcctcccgggggctctggtcccctcctcgattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419787 - DNA, 1485 bp, Homo sapiens
  misc_feature (13)..(13): n is a, c, g, or t
tgcaggtgacccnaggattaatgccaataacctcttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419788 - DNA, 1622 bp, Homo sapiens
cgggcgataggccaagtgcggggacgccgggggggccttcacgggaggcccgggctcttccgggcgtcgcggagccggagggtgcaggcgacgggaagcgcgggtggtcggctggggtccggctcctggagaacatggcccggcctcccgggggctctggtcccctcctcgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419789 - DNA, 1887 bp, Homo sapiens
gcgcctaggtacgggctgagtatcaatcggccgaggccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419790 - DNA, 1675 bp, Homo sapiens
catcgagttccgcatcctgaaagcatggagccaaagacaaagatgactgaaagaactttagactaaaatcttccagttacattgtcttactctcttttacttctcagacacttcccccaccctcatagaacctgttgcatgcaacttagtttcacagctttgcctcttctttttgatgtatttattccagacctttctgccacgattggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419791 - DNA, 2629 bp, Homo sapiens
gcgcctaggtacgggctgagtatcaatcggccgaggccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaattacatggtggtcttgacttttattacagaaagatatgtagtaaatattcagaacagatacacaatgttacttggacatttcagaattatcagagaacatagcataggcagataatttttgtaagggttttctgtttgtttgttttttttttttttagcagcgctctgtcttctaataaaggcctgatttatgaaatgaatgaaaacagagctagtttggttgaactggacttggggtgggtgctttggctacacacctactcaaatccacctcttctctcgacttctctctctctgcagctctttcttgggttctgtggtggaactttctgggctgtgaagcaatgctgttgaaaggccatttggtattagggactcctgtttgtggctcctgggatgaggtggttatgattttgttttccttgtgttttgaacacttagcccctaatt

SEQ ID NO: 419792 - DNA, 1466 bp, Homo sapiens
tgtaaaaataagtctttaattaattcattgttttgttttcctttttcagttagggcctagtcaaaattttgaagatgcgcatatggcagagggcacaggtttctatccctcagaacccatgctctgtagtgaatcggtggaagggcaagtgccacattcattagagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419793 - DNA, 1333 bp, Homo sapiens
  misc_feature (8)..(8): n is a, c, g, or t
gaatcacnttctcacgcttggtctttctgagcaccctgcttaaaacgcagtcacgctcacatgggctgctgccacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419794 - DNA, 1278 bp, Homo sapiens
tctttccttcacccaaggcatcctgcttggtgcacatgtgcataagcacatcactgggctctttcatggaatgagatgaagtgcgcctttgtatacatgattaaaattgaaccctctggtgatgtcaagtatatttatcctttgggtctggaagagagatgatgctgtgaaaactagcaagattattttaatgaacactacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419795 - DNA, 2065 bp, Homo sapiens
gcgcctaggtacgggctgagtatcaatcggccgaggccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419796 - DNA, 1469 bp, Homo sapiens
tgcatcctcataggttaggtctcacaagatttggttttccattctagagttacttcacttaaaataatggcctccagctgcatccaagttgctgcaaaagacattatttcattcctttttatggctgagtagtattccatggtgtatatatgccacattttctttatcagtggtttcttggaatggaatctattcctggacaacaaaggatttcgaatattacataaatttagttgacaaaacagaagcaaggtttgagaaggttgactctgattttgaaagttttactgtgggtaaaatgccatcaaacagcatcgcatgtacagagaaatctttcatgaaaggaagagtgagtcaatgtgacaaacttcactgttgtattattttaagaaattgccacagccacttcagcctttagcaaccagcaccctgatctgtcagcagcaacgaacatggaggcaagaccctctattagcaaaaagattgcaacttgctaaaggctcaggtgattgttagcatatttttaaattaaggtatgtacattgtctttttagatataatgctattgcacatttactatagtgtaaacatagcatagcatttatatacactgggaaaccaaaaaaatttgtgtgacttggtttattgcattggtttgggactaaatccacaatatgtctgaggtgtgcctatagatctttactatgaaagcaaattagaactaaagggaaacatccagatcacttaccttatcttgttcttttatttttcttttttctacagctgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419797 - DNA, 1924 bp, Homo sapiens
gcgcctaggtacgggctgagtatcaatcggccgaggccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggagattggcagccaactattcccaaggccaaccttgtcacagaggaacctttgggtcataccacccctagggctataaatgtatctcttaaaaggtttctgggagtgcaactctcaacac

SEQ ID NO: 419798 - DNA, 1425 bp, Homo sapiens
tgcatcctcataggttaggtctcacaagatttggttttccattctagagttacttcacttaaaataatggcctccagctgcatccaagttgctgcaaaagacattatttcattcctttttatggctgagtagtattccatggtgtatatatgccacattttctttatcagtggtttcttggaatggaatctattcctggacaacaaaggatttcgaatattacataaatttagttgacaaaacagaagcaaggtttgagaaggttgactctgattttgaaagttttactgtgggtaaaatgccatcaaacagcatcgcatgtacagagaaatctttcatgaaaggaagagtgagtcaatgtgacaaacttcactgttgtattattttaagaaattgccacagccacttcagcctttagcaaccagcaccctgatctgtcagcagcaacgaacatggaggcaagaccctctattagcaaaaagattgcaacttgctaaaggctcaggtgattgttagcatatttttaaattaaggtatgtacattgtctttttagatataatgctattgcacatttactatagtgtaaacatagcatagcatttatatacactgggaaaccaaaaaaatttgtgtgacttggtttattgcattggtttgggactaaatccacaatatgtctgaggtgtgcctatagatctttactatgaaagcaaattagaactaaagggaaacatccagatcacttaccttatcttgttcttttatttttcttttttctacagctgtacaggaagaggcacatacaaagaaaagaatcccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419799 - DNA, 2654 bp, Homo sapiens
gcgcctaggtacgggctgagtatcaatcggccgaggccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgaggtgatttccgtaatgacatattcacaagaaagggctcttattgtcttgattactcagctcaccaaaagtttttagttgtaggatttttctgttgcaaatgattacaataaatagccttaaagagactgactctaagcttcatatacctgtgcctgtgtccctaaaactctctcatttttgtgttttgcacaacacaaatcactcattagactaagaagattatttcaggatagagaaatggaagtaaaacaggcttattttctcactagagaccatagtcagtatctgacgtagaaacgagctggcatttctgaactgctttcatggttgagaccaatgtgtaagttaggagagttttgttgacctgttccaagttgctagggtagctttatttctgtatggtcacattatggtgacctggtaattattttggcagtgatgatggtagaacttgtgcatcaggatttcctgctacaaggccaaaagcctgattgtggaacttttttttctgctaccaccattttactacatattagtgttttcagaatgtttgaccctggggtgggtcatgaaatccatttaatgggtcatgttacaaaaaaacaaaacccacaatggaaaaatccatatttattttataaatagtattcctatttataaaataggagtaaacttctatttcaattatgtataggtaggtgtatactgtgttgcaatgtaaaatttttatgtggttcacataaatgtttgaatgatactgctatatgtgatgttaacacataccaccttagtaactgtaaaaatgtggtgggtagatagctcccttaaaaaaaaaaaaaacaacaaaaagagacaacgatccgagaaagaagaagcaatagggaacgcacacaggagagaccaacacaaccacagcaacacagccaacaacaagagaagaaagggtacacagagcaccaggggaagagcgtcaccaagaacagaacaagacgaagaaaaaacacacgggaaagagcaaaagcgatgtaccaacaacaaagaaaagaagaaagcaaacaaataacacagagaagaaaaaacataccaagacacacacgacaacacaaaagaggaaccaaaacaatgagagaccaagaaaacaaacaggcaccaaacaccgggaaaaaaaaaataacacaaaaaaagaagaagaaaaa

SEQ ID NO: 419800 - DNA, 1450 bp, Homo sapiens
gcgcctaggtacgggctgagtatcaatcggccgaggccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcaggtaagtactgcaagcaaaacacagacatcttatgattgctcatacatgtggatggttcctgctctcaagttgcccgtagtctgagagtggcagagagagacaaaaatataaagcactgtgctatattggtgaagttctgggagaaacatactcatatataggatgccaggaattcatggaggagaacatttagaatattgcttctcaaactttaatgcgctttggaatacctggggaccttattaaaatgcagattctgatttagtaactgtagaatggaccgtgaacttcttcatactcctgcataataccaatgttgctggtctgtgagccatgttataagttacaaagatacagagtagttcggtgatcagtgcacacctgcagcatgccatgcactgacctagaaattaggatataaaaatattgggatatttcttgtcttcaaggagtccatacatagagggagacgatgaataaaaagatactca

SEQ ID NO: 419801 - DNA, 676 bp, Homo sapiens
aacagattgatagctatcaggaaatcttcgtatgtatgaatctctcacaagtcttttctacaactgcagcctatgagctagagaggttgggcacagctctactaatttgatatcatggaatttttagcttttatatctaagattcagtttcatcaagtcttgcactgtacttcttccatgagggaatttggttcatgcttatctttgtgaattatttgtgaatatttattcaccatgttgattgggtttggcagaaatagaggacagttttttcacttgattttgggttttgattttactttaaaaaatattctaggggaaaatgtagccaacatatacaaagatcttcagaaactctctcgcctctttaaagaccagctggtgtatcctcttctggcttttacccgacaaggtaagagatgaaatactgtcacaatttaaatgactgtaaagaatagtaagtatacttaatattcttggtgagtatgacatctgactgccctcttttctgctcctggcgaaatgttcctcttctaagactaagcttaatattccttaagtgctatttactttatctttgtatctccatgccattttgtacatatttttattgtagtctcttttccatggactataattgttgatatgatttctttccacctaaggttgggaatac

SEQ ID NO: 419802 - DNA, 1252 bp, Homo sapiens
cgggcgataggccaagtgcggggacgccgggggggccttcacgggaggcccgggctcttccgggcgtcgcggagccggagggtgcaggcgacgggaagcgcgggtggtcggctggggtccggctcctggagaacatggcccggcctcccgggggctctggtcccctcctcgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419803 - DNA, 1698 bp, Homo sapiens
gcgcctaggtacgggctgagtatcaatcggccgaggccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcgggaggcaaatgcacatcataaaactgttcatcaaagatgtgatgcatgatgctgaaggtgtaaccctccaagtgagcggtaatactaagggcacgaacaagctgcggcgcaggacttcggcggaaacgcagcacccgaggacgcaccacgtcacattccagtgaagcaacacacgactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419804 - DNA, 749 bp, Homo sapiens
ccacgcgtccgcggacggcgtgggtcgacccacgcgtcggttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaatta

SEQ ID NO: 419805 - DNA, 1679 bp, Homo sapiens
gcgcctaggtacgggctgagtatcaatcggccgaggccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagacactgaacctaccaggatgtatatagggtaaggaacgaacatcccatatggaaactgaacacctacggatcttccggacttactggactgtaccgttaccgtctatgtcactccgtctcgcgagattagtcgtagagcataatttacgtgattcaaaatgaacccaatcgctgatgagagggtaaataatatacatgggtgatttccgagacaaatagtggtacacaagtacaaagacaacagaattggcacacgcaactgtaccgcgacagacggcacagtacgacagcaacagaaatacccgacaaagggcgaccaggagatggatcctgccaaaatcagcgcagccaccattcccatacataacccaagcgcgttgaacctaagccaatacgag

SEQ ID NO: 419806 - DNA, 2058 bp, Homo sapiens
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcatt

SEQ ID NO: 419807 - DNA, 3300 bp, Homo sapiens
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccggtaacgcgcgtcttggtcccgcctcccaggagcccctatgcgcccacctactcccggcccctcggcttccggaacccgcccgagcccgaagcgcctcttccgaggcgcgggatttcctccccggctgcggctgggacgggggcggccatcggccgttacccgggcgcgagaccgcagcgagcgctgggggcgctcggctttggttctgggatggagagagggcctttaaagagcaggacggacacgctctgaacattccggcccaaactcggtcccccgacccatttcctgtcccgattctttcgaccttgggggcgatggggactgggagctgccttaagccgattctgctcacactctggtgccagcgtgggggaggggggttacgccccggcgctctcctgccctccctgggagtggggacccacacagaaacgggtcactgttacacccgggttctggtgtccgccatatggctgttgagagacgcctcagaaccacctgtgggacggatgggcagcgatgcccgccctgggcctagaggaacacctgggtcccaggcccaaaaccacgtccgccgcccactcttccccgtgcaccgcgagtggaggctgttctgcctttccacttgcttaacatccagtctgtgaagatctaaataaataacgtggaaaatgcaaagtataatgtactaagtgaaagaactcgagcacactgggggtccacgaagctgcagctgcagcccagggtggcacatcggcgagacggtggtgcgcgcctccaatctcggagggcgcccaaaatggaaaatgtttttaggccagggagtgagcataaacattagtgtttttgtggtcatgtagcaaattagggcagaggagagttatttaaaagtgagtttaaaaactgatttcctttcttttgtagataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcatt

SEQ ID NO: 419808 - DNA, 3604 bp, Homo sapiens
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgctgggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtgcatgcaatgctccgactctgcagaggtgccaagtgcccctgctgggccagtcccagagagttaggaagtcaaggcctgcaactcctggttcttcctgtttggaccagttcttgtgccattggcaggatgagaggcagcagccaggcgggagctgtgtctagcagcacctgtagcccacgtgctgctaattagctggaaaactggcgaaggcagaacctttgctaccaggaatcttgacatgtggggtctgtctttgagaatttgtaaatgaacagtccaatatttcctctcggctcattttgcacatccatttttggggaaatgtgatttctctctctttttttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcaaaatctcccagcctagagaccacacctgaaacggctgaagccagcttgcacaagggctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataaattat

SEQ ID NO: 419809 - DNA, 3627 bp, Homo sapiens
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacgtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtgcatgcaatgctccgactctgcagaggtgccaagtgcccctgctgggccagtcccagagagttaggaagtcaaggcctgcaactcctggttcttcctgtttggaccagttcttgtgccattggcaggatgagaggcagcagccaggcgggagctgtgtctagcagcacctgtagcccacgtgctgctaattagctggaaaactggcgaaggcagaacctttgctaccaggaatcttgacatgtggggtctgtctttgagaatttgtaaatgaacagtccaatatttcctctcggctcattttgcacatccatttttggggaaatgtgatttctctctctttttttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcaaaatctcccagcctagagaccacacctgaaacggctgaagccagcttgcacaagggctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataaattat

SEQ ID NO: 419810 - DNA, 3626 bp, Homo sapiens
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtgcatgcaatgctccgactctgcagaggtgccaagtgcccctgctgggccagtcccagagagttaggaagtcaaggcctgcaactcctggttcttcctgtttggaccagttcttgtgccattggcaggatgagaggcagcagccaggcgggagctgtgtctagcagcacctgtagcccacgtgctgctaattagctggaaaactggcgaaggcagaacctttgctaccaggaatcttgacatgtggggtctgtctttgagaatttgtaaatgaacagtccaatatttcctctcggctcattttgcacatccatttttggggaaatgtgatttctctctctttttttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcagctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataaattat

SEQ ID NO: 419811 - DNA, 2800 bp, Homo sapiens
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataaattat

SEQ ID NO: 419812 - DNA, 2296 bp, Homo sapiens
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgctgggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcatt

SEQ ID NO: 419813 - DNA, 1923 bp, Homo sapiens
gtacagaggtacgcgtggccccccgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcatt

SEQ ID NO: 419814 - DNA, 3681 bp, Homo sapiens
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtgcatgcaatgctccgactctgcagaggtgccaagtgcccctgctgggccagtcccagagagttaggaagtcaaggcctgcaactcctggttcttcctgtttggaccagttcttgtgccattggcaggatgagaggcagcagccaggcgggagctgtgtctagcagcacctgtagcccacgtgctgctaattagctggaaaactggcgaaggcagaacctttgctaccaggaatcttgacatgtggggtctgtctttgagaatttgtaaatgaacagtccaatatttcctctcggctcattttgcacatccatttttggggaaatgtgatttctctctctttttttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcaaaatctcccagcctagagaccacacctgaaacggctgaagccagcttgcacaagggctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataaattat

SEQ ID NO: 419815 - DNA, 3401 bp, Homo sapiens
cagttacctccaacagcttcatcacaaatcactcacaaaaatggccttaatcctgaagtttatttacggagagcacacttgctaggtgtgtggcagatatacaggaagcacaagatgaggcagcagatctagaggcaaatgacttccttctccctgcctagtggtgactgccagcatcacgccctcccgggagagataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtgcatgcaatgctccgactctgcagaggtgccaagtgcccctgctgggccagtcccagagagttaggaagtcaaggcctgcaactcctggttcttcctgtttggaccagttcttgtgccattggcaggatgagaggcagcagccaggcgggagctgtgtctagcagcacctgtagcccacgtgctgctaattagctggaaaactggcgaaggcagaacctttgctaccaggaatcttgacatgtggggtctgtctttgagaatttgtaaatgaacagtccaatatttcctctcggctcattttgcacatccatttttggggaaatgtgatttctctctctttttttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcaaaatctcccagcctagagaccacacctgaaacggctgaagccagcttgcacaagggctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataaattat

SEQ ID NO: 419816 - DNA, 3584 bp, Homo sapiens
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtgcatgcaatgctccgactctgcagaggtgccaagtgcccctgctgggccagtcccagagagttaggaagtcaaggcctgcaactcctggttcttcctgtttggaccagttcttgtgccattggcaggatgagaggcagcagccaggcgggagctgtgtctagcagcacctgtagcccacgtgctgctaattagctggaaaactggcgaaggcagaacctttgctaccaggaatcttgacatgtggggtctgtctttgagaatttgtaaatgaacagtccaatatttcctctcggctcattttgcacatccatttttggggaaatgtgatttctctctctttttttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcaaaatctcccagcctagagaccacacctgaaacggctgaagccagcttgcacaaggatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataaattat

SEQ ID NO: 419817 - DNA, 2362 bp, Homo sapiens
  misc_feature (2342)..(2342): n is a, c, g, or t
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggtggaanaagtcgcttttggtccggct

SEQ ID NO: 419818 - DNA, 2389 bp, Homo sapiens
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgctgctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataaattat

SEQ ID NO: 419819 - DNA, 8924 bp, Homo sapiens
ccatggactcaatgtcaatgcttctcatgtgatacacaagaatactcaattaaaaaatgctaagggataagttttttttcagatagagttgagctttaaagggccacaaaccattgaaataggtaagatttgttcctgctcccaagaattaacttattgttcctttgagagcaatatcatacccaatgagactacacaattgagaaaaaatcagttggattaaaaaaatttgtacattaaaattcaaatttccaaagaacctgcaaaggttccaatactagttgattcttatctaactaaatgaaacaatttttgtcctaaatgttcatgatgggaggtaaatgtgataacatatatggggtgtacaattgttttacatgccatgccagacaccagagatatttgtttctaattttcattttcattgaaaacaaaagttgttacttttgcatcctaaagaatggagacaagaagaaaacaaacgtgtatctaaatgtgattaaaatgttaaaaggaaaaaatatcttaatggaaaaaaaataatgatgaaatagaatttacctacattaattccagtcacgatggaaattaaaggagggaagagcagaagcaaaattgtggaagagatgtagactaaaggagcaaatgagcatggctggaagatagtaatcattcctggtcagggtgtgttttcagctttgctgaatccagccttcacagagagtcatggacacacaccaaccacaagagtttatacataaaaaaggcaaaaatttgagagtacaatatactctctgcataataggtaagtgatgatgtaccaagttctcccttagtgtataaataaactcaagagatcaatatttttcttatcacatctcttacaagaaacaagggaattgataatgtcaaaggacactttctgcaacctagtaaagttcgataataaaaatagtgattaaaaggaaccaaatacctaaattgttgaatgtgtttatttttagtcagacattgttcttagcacttacaaaattgatgctccctttagcaataatgaatactcttatttttcatattaactgaacacctaccatgtgtctacccccattaattcactggagatatcagtgaccaaagaagactgataggttctactgttattcctatttacaaaataaaaaatagaagtataaggaactatcaaattatgaagccattgtttgaacccaaaatctgactgagccctcagttcttacatgctcccaggaatatttctggtcataagaactagagcgatttctagattgatcaatattttcccagtagagtcctgcctaggtaatgacagagtctttctcttcagctgtttactagtcttcttcactgaaattccccatttgaccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggatgcactgctgtgacatgctggatggtgggaccttccctcccgccctgggcccccgcagggctcctccctgtctgcatcagcagctccagggttccctggcggggctgagagaggacacaccctgcatcgtgcctggccacgcttcactgtgctgctcttccagagtaggagagtggctcccagcaggctgcacagccccccagcatgccaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaggaggacgcgggctgtgtgcgcgcgcggggtgcaccgagtgaggaggagctccaggacagcagggtctacgtcagcagcctgtagtgggcgctgccagatgcgggcttttttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgctgccctctcccagctcgcaggccccgggccggccgcgcctctgcgggagagcaccccggcttcccgcgcgccctcaccaaaaggaccctacagcaaacggggtctttcgactctgcttgtagaaaccatttgcacatattctgtacgagcctgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacggccacgccgagctcccggccagccgccggcccgcaggcagcgcgagggaggagctgcgccgccgggccggggccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttacc

SEQ ID NO: 419820 - DNA, 8382 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaggaggacgcgggctgtgtgcgcgcgcggggtgcaccgagtgaggaggagctccaggacagcagggtctacgtcagcagcctgtagtgggcgctgccagatgcgggcttttttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgctgccctctcccagctcgcaggccccgggccggccgcgcctctgcgggagagcaccccggcttcccgcgcgccctcaccaaaaggaccctacagcaaacggggtctttcgactctgcttgtagaaaccatttgcacatattctgtacgagcctgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacggccacgccgagctcccggccagccgccggcccgcaggcagcgcgagggaggagctgcgccgccgggccggggccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagctttacctttgaactcaagtgcttttctatatgtggttgggggaaagggaacaagttttctttagtttgcacaatgagcaaaggtatcaccagtgtagtcattattctgctctccacaaacaggtttggacattactgttttgcatatcttgtgtttgcttacatttccctcaatttttccaaaatcgtttgctgggtatgtttgtaccgcctct

SEQ ID NO: 419821 - DNA, 8228 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaggaggacgcgggctgtgtgcgcgcgcggggtgcaccgagtgaggaggagctccaggacagcagggtctacgtcagcagcctgtagtgggcgctgccagatgcgggcttttttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgctgccctctcccagctcgcaggccccgggccggccgcgcctctgcgggagagcaccccggcttcccgcgcgccctcaccaaaaggaccctacagcaaacggggtctttcgactctgcttgtagaaaccatttgcacatattctgtacgagcctgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacggccacgccgagctcccggccagccgccggcccgcaggcagcgcgagggaggagctgcgccgccgggccggggccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagcttt

SEQ ID NO: 419822 - DNA, 8195 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaggaggacgcgggctgtgtgcgcgcgcggggtgcaccgagtgaggaggagctccaggacagcagggtctacgtcagcagcctgtagtgggcgctgccagatgcgggcttttttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgctgccctctcccagctcgcaggccccgggccggccgcgcctctgcgggagagcaccccggcttcccgcgcgccctcaccaaaaggaccctacagcaaacggggtctttcgactctgcttgtagaaaccatttgcacatattctgtacgagcctgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacggccacgccgagctcccggccagccgccggcccgcaggcagcgcgagggaggagctgcgccgccgggccggggccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagcttt

SEQ ID NO: 419823 - DNA, 8315 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaggaggacgcgggctgtgtgcgcgcgcggggtgcaccgagtgaggaggagctccaggacagcagggtctacgtcagcagcctgtagtgggcgctgccagatgcgggcttttttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgctgccctctcccagctcgcaggccccgggccggccgcgcctctgcgggagagcaccccggcttcccgcgcgccctcaccaaaaggaccctacagcaaacggggtctttcgactctgcttgtagaaaccatttgcacatattctgtacgagcctgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacggccacgccgagctcccggccagccgccggcccgcaggcagcgcgagggaggagctgcgccgccgggccggggccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagcttt

SEQ ID NO: 419824 - DNA, 8231 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaggaggacgcgggctgtgtgcgcgcgcggggtgcaccgagtgaggaggagctccaggacagcagggtctacgtcagcagcctgtagtgggcgctgccagatgcgggcttttttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgctgccctctcccagctcgcaggccccgggccggccgcgcctctgcgggagagcaccccggcttcccgcgcgccctcaccaaaaggaccctacagcaaacggggtctttcgactctgcttgtagaaaccatttgcacatattctgtacgagcctgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacggccacgccgagctcccggccagccgccggcccgcaggcagcgcgagggaggagctgcgccgccgggccggggccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagcttt

SEQ ID NO: 419825 - DNA, 8138 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaggaggacgcgggctgtgtgcgcgcgcggggtgcaccgagtgaggaggagctccaggacagcagggtctacgtcagcagcctgtagtgggcgctgccagatgcgggcttttttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgctgccctctcccagctcgcaggccccgggccggccgcgcctctgcgggagagcaccccggcttcccgcgcgccctcaccaaaaggaccctacagcaaacggggtctttcgactctgcttgtagaaaccatttgcacatattctgtacgagcctgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacggccacgccgagctcccggccagccgccggcccgcaggcagcgcgagggaggagctgcgccgccgggccggggccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagcttt

SEQ ID NO: 419826 - DNA, 8174 bp, Homo sapiens
  misc_feature (4717)..(4717): n is a, c, g, or t
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctcagagaancagagctgtcatcccaagtccagtaccaagccaaagaagcttctctcttggaacgtagaaggaagagctctcatcccaagtccagtaccaagccaaacaagcttctctcttccggagggtcgactggctgggtggaggatgccagggccctggagggacaggtcttggcccgaggctgtggctggctggggagcttggaggaaagggagcgtggtcctcaccatcctccccttggattccaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaggaggacgcgggctgtgtgcgcgcgcggggtgcaccgagtgaggaggagctccaggacagcagggtctacgtcagcagcctgtagtgggcgctgccagatgcgggcttttttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgctgccctctcccagctcgcaggccccgggccggccgcgcctctgcgggagagcaccccggcttcccgcgcgccctcaccaaaaggaccctacagcaaacggggtctttcgactctgcttgtagaaaccatttgcacatattctgtacgagcctgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacggccacgccgagctcccggccagccgccggcccgcaggcagcgcgagggaggagctgcgccgccgggccggggccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagcttt

SEQ ID NO: 419827 - DNA, 4976 bp, Homo sapiens
ctgtgcagggctacagaggaaggggaagagataatccctgtccatgaaaaataacaagcttcatggggcacacagcccaggctcaaatgaatggcatatgtatgtaaactgcttatgtctaaaaccaggccattggtgatgatcggagtagcatgggtcatgctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaggaggacgcgggctgtgtgcgcgcgcggggtgcaccgagtgaggaggagctccaggacagcagggtctacgtcagcagcctgtagtgggcgctgccagatgcgggcttttttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgctgccctctcccagctcgcaggccccgggccggccgcgcctctgcgggagagcaccccggcttcccgcgcgccctcaccaaaaggaccctacagcaaacggggtctttcgactctgcttgtagaaaccatttgcacatattctgtacgagcctgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacggccacgccgagctcccggccagccgccggcccgcaggcagcgcgagggaggagctgcgccgccgggccggggccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagcttt

SEQ ID NO: 419828 - DNA, 4381 bp, Homo sapiens
cggccgccctcccatcggagggggaagtctagtgcagcaaaccctggcctgccttccgccactgccactgaggtctgtatttctcggaggggccctcctgttctcacccccctcttgctgtgctaactgcacctcctgttgccgacgggttccagaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaggaggacgcgggctgtgtgcgcgcgcggggtgcaccgagtgaggaggagctccaggacagcagggtctacgtcagcagcctgtagtgggcgctgccagatgcgggcttttttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgctgccctctcccagctcgcaggccccgggccggccgcgcctctgcgggagagcaccccggcttcccgcgcgccctcaccaaaaggaccctacagcaaacggggtctttcgactctgcttgtagaaaccatttgcacatattctgtacgagcctgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacggccacgccgagctcccggccagccgccggcccgcaggcagcgcgagggaggagctgcgccgccgggccggggccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagcttt

SEQ ID NO: 419829 - DNA, 2325 bp, Homo sapiens
cttttacaacagtgagtggaaaggactgaccttctaaattaacagcagcctaaatggaaagcctactttcttatgttgcttaattcacatctggggacctgatttaaacatgtcttgcgctgttgttgccatggttgctttgcccatcccatccctcatcctgtcacttttctctctgacttctttctctgcccacatgtctccctccctgctgctcccgtctcctgtcttcttctggccatttgagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatgtatgcatcgcctgtgtcttctgcactccttccccctggggctgtgccaggcccacagcttctgttgctgacatcattgttcaatcaggagcccaattctaggtgtcataattagatccacaactaacatttcattaagagagtagggctttgatagaaaaccaccctaggaccacaagcaaataaaagagcatgtaccca

SEQ ID NO: 419830 - DNA, 423 bp, Homo sapiens
agtgaggggcgagaagagccatggtgctgcatcttgggttggaggaaacctgaattcacagccaaccccacccttctctccctgtcccctttccagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaaggtgagcggcggccccagctctgctctggtttcctcctggtaactcagccccaaggcccaggggagggcataaccacaggcagaaggtggaggggaaagcagccaatggtcggggctcttggcaggtgctgtgctggagacaccaagggcctggcagttccaaagcc

SEQ ID NO: 419831 - DNA, 8171 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaggaggacgcgggctgtgtgcgcgcgcggggtgcaccgagtgaggaggagctccaggacagcagggtctacgtcagcagcctgtagtgggcgctgccagatgcgggcttttttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgctgccctctcccagctcgcaggccccgggccggccgcgcctctgcgggagagcaccccggcttcccgcgcgccctcaccaaaaggaccctacagcaaacggggtctttcgactctgcttgtagaaaccatttgcacatattctgtacgagcctgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacggccacgccgagctcccggccagccgccggcccgcaggcagcgcgagggaggagctgcgccgccgggccggggccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagcttt

SEQ ID NO: 419832 - DNA, 8276 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacagggaaaggcacgttccggtgtgtgaggatctggagctcaggagggattcaggctcagcagggactcaggctcactgccttctgctcaggagagcaaacccctctaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaggaggacgcgggctgtgtgcgcgcgcggggtgcaccgagtgaggaggagctccaggacagcagggtctacgtcagcagcctgtagtgggcgctgccagatgcgggcttttttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgctgccctctcccagctcgcaggccccgggccggccgcgcctctgcgggagagcaccccggcttcccgcgcgccctcaccaaaaggaccctacagcaaacggggtctttcgactctgcttgtagaaaccatttgcacatattctgtacgagcctgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacggccacgccgagctcccggccagccgccggcccgcaggcagcgcgagggaggagctgcgccgccgggccggggccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagcttt

SEQ ID NO: 419833 - DNA, 8255 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaggaggacgcgggctgtgtgcgcgcgcggggtgcaccgagtgaggaggagctccaggacagcagggtctacgtcagcagcctgtagtgggcgctgccagatgcgggcttttttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgctgccctctcccagctcgcaggccccgggccggccgcgcctctgcgggagagcaccccggcttcccgcgcgccctcaccaaaaggaccctacagcaaacggggtctttcgactctgcttgtagaaaccatttgcacatattctgtacgagcctgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacggccacgccgagctcccggccagccgccggcccgcaggcagcgcgagggaggagctgcgccgccgggccggggccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagcttt

SEQ ID NO: 419834 - DNA, 8222 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatcactatttctgtgatgcatggaatacatttgacgccttgattgttgtgggtagcattgttgatatagcaatcaccgaggtaaacaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaggaggacgcgggctgtgtgcgcgcgcggggtgcaccgagtgaggaggagctccaggacagcagggtctacgtcagcagcctgtagtgggcgctgccagatgcgggcttttttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgctgccctctcccagctcgcaggccccgggccggccgcgcctctgcgggagagcaccccggcttcccgcgcgccctcaccaaaaggaccctacagcaaacggggtctttcgactctgcttgtagaaaccatttgcacatattctgtacgagcctgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacggccacgccgagctcccggccagccgccggcccgcaggcagcgcgagggaggagctgcgccgccgggccggggccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagcttt

SEQ ID NO: 419835 - DNA, 9675 bp, Homo sapiens
ccatggactcaatgtcaatgcttctcatgtgatacacaagaatactcaattaaaaaatgctaagggataagttttttttcagatagagttgagctttaaagggccacaaaccattgaaataggtaagatttgttcctgctcccaagaattaacttattgttcctttgagagcaatatcatacccaatgagactacacaattgagaaaaaatcagttggattaaaaaaatttgtacattaaaattcaaatttccaaagaacctgcaaaggttccaatactagttgattcttatctaactaaatgaaacaatttttgtcctaaatgttcatgatgggaggtaaatgtgataacatatatggggtgtacaattgttttacatgccatgccagacaccagagatatttgtttctaattttcattttcattgaaaacaaaagttgttacttttgcatcctaaagaatggagacaagaagaaaacaaacgtgtatctaaatgtgattaaaatgttaaaaggaaaaaatatcttaatggaaaaaaaataatgatgaaatagaatttacctacattaattccagtcacgatggaaattaaaggagggaagagcagaagcaaaattgtggaagagatgtagactaaaggagcaaatgagcatggctggaagatagtaatcattcctggtcagggtgtgttttcagctttgctgaatccagccttcacagagagtcatggacacacaccaaccacaagagtttatacataaaaaaggcaaaaatttgagagtacaatatactctctgcataataggtaagtgatgatgtaccaagttctcccttagtgtataaataaactcaagagatcaatatttttcttatcacatctcttacaagaaacaagggaattgataatgtcaaaggacactttctgcaacctagtaaagttcgataataaaaatagtgattaaaaggaaccaaatacctaaattgttgaatgtgtttatttttagtcagacattgttcttagcacttacaaaattgatgctccctttagcaataatgaatactcttatttttcatattaactgaacacctaccatgtgtctacccccattaattcactggagatatcagtgaccaaagaagactgataggttctactgttattcctatttacaaaataaaaaatagaagtataaggaactatcaaattatgaagccattgtttgaacccaaaatctgactgagccctcagttcttacatgctcccaggaatatttctggtcataagaactagagcgatttctagattgatcaatattttcccagtagagtcctgcctaggtaatgacagagtctttctcttcagctgtttactagtcttcttcactgaaattccccatttgaccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggatgcactgctgtgacatgctggatggtgggaccttccctcccgccctgggcccccgcagggctcctccctgtctgcatcagcagctccagggttccctggcggggctgagagaggacacaccctgcatcgtgcctggccacgcttcactgtgctgctcttccagagtaggagagtggctcccagcaggctgcacagccccccagcatgccaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaggaggacgcgggctgtgtgcgcgcgcggggtgcaccgagtgaggaggagctccaggacagcagggtctacgtcagcagcctgtagtgggcgctgccagatgcgggcttttttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgctgccctctcccagctcgcaggccccgggccggccgcgcctctgcgggagagcaccccggcttcccgcgcgccctcaccaaaaggaccctacagcaaacggggtctttcgactctgcttgtagaaaccatttgcacatattctgtacgagcctgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacggccacgccgagctcccggccagccgccggcccgcaggcagcgcgagggaggagctgcgccgccgggccggggccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagcttt

SEQ ID NO: 419836 - DNA, 7502 bp, Homo sapiens
cttttacaacagtgagtggaaaggactgaccttctaaattaacagcagcctaaatggaaagcctactttcttatgttgcttaattcacatctggggacctgatttaaacatgtcttgcgctgttgttgccatggttgctttgcccatcccatccctcatcctgtcacttttctctctgacttctttctctgcccacatgtctccctccctgctgctcccgtctcctgtcttcttctggccatttgagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaggaggacgcgggctgtgtgcgcgcgcggggtgcaccgagtgaggaggagctccaggacagcagggtctacgtcagcagcctgtagtgggcgctgccagatgcgggcttttttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgctgccctctcccagctcgcaggccccgggccggccgcgcctctgcgggagagcaccccggcttcccgcgcgccctcaccaaaaggaccctacagcaaacggggtctttcgactctgcttgtagaaaccatttgcacatattctgtacgagcctgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacggccacgccgagctcccggccagccgccggcccgcaggcagcgcgagggaggagctgcgccgccgggccggggccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagcttt

SEQ ID NO: 419837 - DNA, 6199 bp, Homo sapiens
cttttacaacagtgagtggaaaggactgaccttctaaattaacagcagcctaaatggaaagcctactttcttatgttgcttaattcacatctggggacctgatttaaacatgtcttgcgctgttgttgccatggttgctttgcccatcccatccctcatcctgtcacttttctctctgacttctttctctgcccacatgtctccctccctgctgctcccgtctcctgtcttcttctggccatttgagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtaggtgactcgcagatgggcaggggggagaggccacgggcaacaaggggacttggcatgcggggctgagaagggagcacctggctcttgccaaattcattgcagtcaatatctgagcccgaaagaccctccctctcagggctgcaggagggctcgtgtgcggaaagccatgactgcacaagatgctatgggctctcttgaggctaggcccactgcagagggcggcagaaaccactgagcaacttatcccttatactgcagctgctcgacatgcaaatgtgagcctggctgcctttatacacagacaggcaagatccaaggtgctcaggcctgactgcccgtgagcatcacctggggagctttggaaacccgggacagattaactgatgattgttaaagctcttcgatgattttaacgtgtagcaaggttgagagccactagcctagaacaagcgagctttcagtcccactgtgctctgcctggtcagagcatctagtgcaatcccggcaccacattattagggacctttgacacactggaacaaacccaacagaggatgaccaggatggcaaggttcctagaaaccatttcctaggagaaccatttcagggaattcgggaagaaaacctggagaggaggtgactttggagggtgcgatacacctctcacacctgcaacgggtgggatggggaaagggtggcaggctcagcccaccagcggacagatttcagctcacatggggaagacctt

SEQ ID NO: 419838 - DNA, 735 bp, Homo sapiens
cttttacaacagtgagtggaaaggactgaccttctaaattaacagcagcctaaatggaaagcctactttcttatgttgcttaattcacatctggggacctgatttaaacatgtcttgcgctgttgttgccatggttgctttgcccatcccatccctcatcctgtcacttttctctctgacttctttctctgcccacatgtctccctccctgctgctcccgtctcctgtcttcttctggccatttgagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcgggtaagcaggaccaaggaaaaaggtcttgatttttccatttatttttatttattctttctgctattcctggctgtattctttttctggctctgatgaacctgggataaggggtcaccacaggagccttgaagtggatgtccttgtcctggctgggtaaagggtcagatgtgccactggtcttggtggt

SEQ ID NO: 419839 - DNA, 2062 bp, Homo sapiens
gtggtttctgcagtgtcgtgaacttggctaaactgaactgtgttcccagaattcccttccttgtttgtttctctggtgagggttggccacgagagagatttgcatgaggtttggaagtggaagtagagcaacagccatgcgtattcactggaagtggatgtaggtcaggccctgttccatcacgtgcacgttaccatggatctcctgcacttgtggtgtgggcagccgctgggcccacggctcctcccactcccgcagaactctgcctttggcttttccagaccctgggccgggtatgagaaccagcttcttggtctgcagccacaaggatgaaggtttggggatgagagaccagcacgggctctgatgagagacaggtgcaggtcccagcttgtggcttgcaggtctcagtcgtacttgctctccctcaccatcctttccaaccgcctggcctgtggtctggtgaagaagaaacagccgaaccgagactttcaccagcccctctaattgctcaaaccgctttcacaatcctctctttctacatcattcctagtggttcttttctgatggaacctctgactggtaacatggcattaccagtcctttccctctcatgttttgctatttcctgatggaacctgggagtctgagtgatttgtatttcaagaagcagttatgctggatctctttgttggttaataccccatgacctatctggccgttatgggatatttcagggataggagttgtgaaagagcccttggctggacgtttctagccttaatctttggcaagccatttcatttccctgagcctcagtttccgccttcctacagcgtgagcaggtctgggtgggctctcaagcccctttcagctctaagattccaagtctgtgattccgatacatcttgactacaatgagcgtgtttaccttttgtctctgagcagtggccctgggtcttggtagtgactaaattccgagctcccaaggtgcagctgcttttcttccttttaattataaattagctgttcattggctgcttctttctagagcctgttttgcttatcttgcaatctgttcatttctgttgatgaacacagtcaaataggcctctatgtgcagtctcctggtttccctggtcaaagtggaaggttggtagaaactggccttcatgtctttgtttccctcaaagttttattcttagtaacgctatatatggttttatagaccacacatatatagtttcctgtgtcttagatgataacatccttaaaatatgaaatatattttgaacctagatacctacccagtattctctgccacagagtaaacatttcattaaatgagtttcaaggactccataccctgatataggagtacattcaagaaatgagtttaggccgggcgcggtggctcacacctgtaatcccagcacttgggaggccgagacgagtggatcacctgaggtcaggagttccagaccagcctgaccaacatggtgaaaccccatctctactaaaaaaaatacagaaattacccgggcatggtggctggtgcctgtaatccccgctacttgggaggccaaggtgggagaatcgcttgaacctgggaggcggaggttgcagtgagccaagttcgtgccattgcactctggcctgggtaacaagagtgaaactccgtttagaaatgagtttagtctgggagaatctgctttttgagtaaaaaagtttgattttatgtatgtgtgcgtctgtatatatgtttctgtatcctgagtatttctttgcggcttcttcagttatgaaagaggttggtactgttacccttacgttataggtattacaaactcggttttacaaggttacataaactaatggccctggggcgaatgacgtatgccacttttgtgttgatttgtagaacttacttagctttggcatttcccctagtaattcccaaggcaaaaccaggaattgtcagagacgtgaccagacatgtattaaaattctagtgcaattgggaaacttggtcttcctgatttgtttatacttcagccaaacc

SEQ ID NO: 419840 - DNA, 1521 bp, Homo sapiens
taacgggatccggcgcccacggcgccgccggcgccggggctccgagtggtcactggggactcgacggacaggcgtaccagtcggcccctcagtggctagccggatggagccgggagtcggagtgatgatgcagagcagcatgctggatcctcgtggtctaccccatgacctatctggccgttatgggatatttcagggataggagttgtgaaagagcccttggctggacgtttctagccttaatctttggcaagccatttcatttccctgagcctcagtttccgccttcctacagcgtgagcaggtctgggtgggctctcaagcccctttcagctctaagattccaagtctgtgattccgatacatcttgactacaatgagcgtgtttaccttttgtctctgagcagtggccctgggtcttggtagtgactaaattccgagctcccaaggtgcagctgcttttcttccttttaattataaattagctgttcattggctgcttctttctagagcctgttttgcttatcttgcaatctgttcatttctgttgatgaacacagtcaaataggcctctatgtgcagtctcctggtttccctggtcaaagtggaaggttggtagaaactggccttcatgtctttgtttccctcaaagttttattcttagtaacgctatatatggttttatagaccacacatatatagtttcctgtgtcttagatgataacatccttaaaatatgaaatatattttgaacctagatacctacccagtattctctgccacagagtaaacatttcattaaatgagtttcaaggactccataccctgatataggagtacattcaagaaatgagtttaggccgggcgcggtggctcacacctgtaatcccagcacttgggaggccgagacgagtggatcacctgaggtcaggagttccagaccagcctgaccaacatggtgaaaccccatctctactaaaaaaaatacagaaattacccgggcatggtggctggtgcctgtaatccccgctacttgggaggccaaggtgggagaatcgcttgaacctgggaggcggaggttgcagtgagccaagttcgtgccattgcactctggcctgggtaacaagagtgaaactccgtttagaaatgagtttagtctgggagaatctgctttttgagtaaaaaagtttgattttatgtatgtgtgcgtctgtatatatgtttctgtatcctgagtatttctttgcggcttcttcagttatgaaagaggttggtactgttacccttacgttataggtattacaaactcggttttacaaggttacataaactaatggccctggggcgaatgacgtatgccacttttgtgttgatttgtagaacttacttagctttggcatttcccctagtaattcccaaggcaaaaccaggaattgtcagagacgtgaccagacatgtattaaaattctagtgcaattgggaaacttggtcttcctgatttgtttatacttcagccaaacc

SEQ ID NO: 419841 - DNA, 1020 bp, Homo sapiens
ctcagcctcccaaagtgctgggattataggcgtgcccattgtgcctggccaagccaccacgcctggcctcggatggattttagatgcctgatgtaggtaaagggcacggagacttcaggaagtcctgaaggcttctctacaggtcctctttagctagtccatatctaccatctacttcacctcccaataccagtcccctctgggaatacacagctcttgtagcaatgttacctgctaaggcccctgttcctttcccgtcatcaggagaactcactttctgtacctgagctatgtatggggtcctgtcctaccaagagcctattatagttcatcatgacacaaacggtgggcaacaaagaagttaaaaacatttctcaagagggaggaaacacaggggcagtcctggggcagaagggaaccaagcggagaaggcatgtttcctagggagagtcctctctgatagtctattaactagtgttatcccaaatacaagccagagaccgtaacgattctgtgtcctagtgatccaagagacaggaatctttcccccgggtccagatgaatgaacactgaagtgtcaccccactcaggactccccacccccttcctcactgaccagctacctgtgtcctgacacatactggtttaaaaagctttcccgaatagcctcacctgggcaaaggatcaaggccagcagggcccagacaccaaacagaagcgttttcatcctgataagaagggccaaaggctggagagaaaaagacagcaatgctggagaaagtgaccaaaaatatatatataaggaaaattgcttatttgatattaaaactcagtccctttttctgaaacctcactagtctagaaaaattacagcaaaaacatcagcagtgaaggtgtactaaaagaatgtcttatatctatttatttcagtttagcttatgtgcatagcaaaaacatgggggaaaatatgaaaaaggatgaggcgatattatcaagattcctgtactaagttgtattcta

SEQ ID NO: 419842 - DNA, 1021 bp, Homo sapiens
gggagccagcaggcccctcgctcaaccccacgctggcagccaccgcggccctcatccccctgcaccgacgcgccggagacatccgcccaggcccgcttccgggaggaagtgacgctcccagccagcttccggtccaggagactcggccccgcctctgcgccgggcagcttaaagggaccacgacccccaggaggattgaaggagaccggtggggacggggcggggcgcagccttgcgaagccctaacgcagcgctggggaggggggcggccgaaaggggggcggtggtcgggccgcgcaagcggagatggaatggggcccgggctcagactggtcacggggggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacggcagctgggccgccggcgcccggagccggctggtggcgggaacgtctcagccaaacctggagcgcccccccagccggctgtctccgccagaggcggctttccaaaggatgctggcgatggagctgcggagccctgaccatccccgagcagaataccctgacttctctccctccccagggccggtggctggactctgaacaactcccttcagtaaaggggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggtggtgttacatgtccatttcatgttttgggggcttttagccccacaaaacaccttcagtagagccttgattaaaaggaaacctgcagactctcc

SEQ ID NO: 419843 - DNA, 890 bp, Homo sapiens
gggagccagcaggcccctcgctcaaccccacgctggcagccaccgcggccctcatccccctgcaccgacgcgccggagacatccgcccaggcccgcttccgggaggaagtgacgctcccagccagcttccggtccaggagactcggccccgcctctgcgccgggcagcttaaagggaccacgacccccaggaggattgaaggagaccgggggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacggcagctgggccgccggcgcccggagccggctggtggcgggaacgtctcagccaaacctggagcgcccccccagccggctgtctccgccagaggcggctttccaaaggatgctggcgatggagctgcggagccctgaccatccccgagcagaataccctgacttctctccctccccagggccggtggctggactctgaacaactcccttcagtaaaggggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggtggtgttacatgtccatttcatgttttgggggcttttagccccacaaaacaccttcagtagagccttgattaaaaggaaacctgcagactctcc

SEQ ID NO: 419844 - DNA, 379 bp, Homo sapiens
ctgaggtactctacaggatcttatgctgctccctcttcagccggtggctggactctgaacaactcccttcagtaaaggggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggtggtgttacatgtccatttcatgttttgggggcttttagccccacaaaacaccttcagtagagccttgattaaaaggaaacctgcagactctcc

SEQ ID NO: 419845 - DNA, 1112 bp, Homo sapiens
gggagccagcaggcccctcgctcaaccccacgctggcagccaccgcggccctcatccccctgcaccgacgcgccggagacatccgcccaggcccgcttccgggaggaagtgacgctcccagccagcttccggtccaggagactcggccccgcctctgcgccgggcagcttaaagggaccacgacccccaggaggattgaaggagaccggtggggacggggcggggcgcagccttgcgaagccctaacgcagcgctggggaggggggcggccgaaaggggggcggtggtcgggccgcgcaagcggagatggaatggggcccgggctcagactggtcacgggggtgagagggggcccgtcggggcgggaggaaggggcttggccccgcgcaagcgccggccctgaccgtctgtctctcgctctctcccgggcagggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacggcagctgggccgccggcgcccggagccggctggtggcgggaacgtctcagccaaacctggagcgcccccccagccggctgtctccgccagaggcggctttccaaaggatgctggcgatggagctgcggagccctgaccatccccgagcagaataccctgacttctctccctccccagggccggtggctggactctgaacaactcccttcagtaaaggggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggtggtgttacatgtccatttcatgttttgggggcttttagccccacaaaacaccttcagtagagccttgattaaaaggaaacctgcagactctcc

SEQ ID NO: 419846 - DNA, 1412 bp, Homo sapiens
gggagccagcaggcccctcgctcaaccccacgctggcagccaccgcggccctcatccccctgcaccgacgcgccggagacatccgcccaggcccgcttccgggaggaagtgacgctcccagccagcttccggtccaggagactcggccccgcctctgcgccgggcagcttaaagggaccacgacccccaggaggattgaaggagaccggtggggacggggcggggcgcagccttgcgaagccctaacgcagcgctggggaggggggcggccgaaaggggggcggtggtcgggccgcgcaagcggagatggaatggggcccgggctcagactggtcacgggggtgagagggggcccgtcggggcgggaggaaggggcttggccccgcgcaagcgccggccctgaccgtctgtctctcgctctctcccgggcagggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacggcagctgggccgccggcgcccggagccggctggtggcgggaacgtctcagccaaacctggagcgcccccccagccggctgtctccgccagaggcggctttccaaaggatgctggcgatggagctgcggagccctgaccatccccgagcagaataccctgacttctctccctccccagggccggtggctggactctgaacaactcccttcagtaaaggggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggtggtgttacatgtccatttcatgttttgggggcttttagccccacaaaacaccttcagtagagccttgattaaaaggaaacctgcagactctccataactaatttgtgtagtataatataataatgagtatgtgagcaaaagaagtgagcaagaagctgaggaatgagtgagggaggcgagtggagaaagaacaatgagagcgggcaagatgcgagatagagaggagtatgaaagaggcaactcgtgcgacccgaacgcccacgcgcaggaagaagagagggcgtaagaagacgacaggagagtcgagccacacagagccagacgacagagcgagcggagcgcggcgcatcccacgtgggaacacgtacgcaaatagatgtaccacacaaccgc

SEQ ID NO: 419847 - DNA, 1102 bp, Homo sapiens
gggagccagcaggcccctcgctcaaccccacgctggcagccaccgcggccctcatccccctgcaccgacgcgccggagacatccgcccaggcccgcttccgggaggaagtgacgctcccagccagcttccggtccaggagactcggccccgcctctgcgccgggcagcttaaagggaccacgacccccaggaggattgaaggagaccggtggggacggggcggggcgcagccttgcgaagccctaacgcagcgctggggaggggggcggccgaaaggggggcggtggtcgggccgcgcaagcggagatggaatggggcccgggctcagactggtcacggggggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacggcagctgggccgccggcgcccggagccggctggtggcgggaacgtctcagccaaacctggagcgcccccccagccggctgtctccgccagaggcggctttccaaaggatgctggcgatggagctgcggagccctgaccatccccgagcagaataccctgacttctctccctccccagggccagtgaagcagaatcacgagatacaagcacccaacagtgagaaaataagccagtgcaacatgatagcgaatagacgaattatcagaggacacatcagcctgggaggtgaggcaggcgacaagcaatggcaagcaagaggtaacagcaccccactatcataccaagagcagaaaaaggcaggagcaaggacagaagaaagaagcatccagaaaaaaacccagggacagattaccgcagatattggggcaggaccagcagtggctcgccaagaagtgggtctgaggcctggctatggggggggatccagggtggggtggttacataggtccattttccatggtatttgggggggccataaatgcccccacaaaaacaccttccagtaagaagccgttgattaaaaaccggaaacctggcag

SEQ ID NO: 419848 - DNA, 980 bp, Homo sapiens
gggagccagcaggcccctcgctcaaccccacgctggcagccaccgcggccctcatccccctgcaccgacgcgccggagacatccgcccaggcccgcttccgggaggaagtgacgctcccagccagcttccggtccaggagactcggccccgcctctgcgccgggcagcttaaagggaccacgacccccaggaggattgaaggagaccgggggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacggcagctgggccgccggcgcccggagccggctggtggcgggaacgtctcagccaaacctggagcgcccccccagccggctgtctccgccagaggcggctttccaaaggatgctggcgatggagctgcggagccctgaccatccccgagcagaataccctgacttctctccctccccagggccggtggctggactctgaacaactcccttcagtaaaggggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggtggtgttacatgtccatttcatgttttgggggcttttagccccacaaaacaccttcagtagagccttgattaaaaggaaacctgcagactctccaaaaaaaagcacgcaaacaaggaaagaaaccgcgcgtaaggggggaaaagggaaagggccaggagagggcgcggccggtggcaagggaag

SEQ ID NO: 419849 - DNA, 1202 bp, Homo sapiens
gggagccagcaggcccctcgctcaaccccacgctggcagccaccgcggccctcatccccctgcaccgacgcgccggagacatccgcccaggcccgcttccgggaggaagtgacgctcccagccagcttccggtccaggagactcggccccgcctctgcgccgggcagcttaaagggaccacgacccccaggaggattgaaggagaccggtggggacggggcggggcgcagccttgcgaagccctaacgcagcgctggggaggggggcggccgaaaggggggcggtggtcgggccgcgcaagcggagatggaatggggcccgggctcagactggtcacgggggtgagagggggcccgtcggggcgggaggaaggggcttggccccgcgcaagcgccggccctgaccgtctgtctctcgctctctcccgggcagggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacggcagctgggccgccggcgcccggagccggctggtggcgggaacgtctcagccaaacctggagcgcccccccagccggctgtctccgccagaggcggctttccaaaggatgctggcgatggagctgcggagccctgaccatccccgagcagaataccctgacttctctccctccccagggccggtggctggactctgaacaactcccttcagtaaaggggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggtggtgttacatgtccatttcatgttttgggggcttttagccccacaaaacaccttcagtagagccttgattaaaaggaaacctgcagactctccaaaaaaaagcacgcaaacaaggaaagaaaccgcgcgtaaggggggaaaagggaaagggccaggagagggcgcggccggtggcaagggaag

SEQ ID NO: 419850 - DNA, 1089 bp, Homo sapiens
gggagccagcaggcccctcgctcaaccccacgctggcagccaccgcggccctcatccccctgcaccgacgcgccggagacatccgcccaggcccgcttccgggaggaagtgacgctcccagccagcttccggtccaggagactcggccccgcctctgcgccgggcagcttaaagggaccacgacccccaggaggattgaaggagaccggtggggacggggcggggcgcagccttgcgaagccctaacgcagcgctggggaggggggcggccgaaaggggggcggtggtcgggccgcgcaagcggagatggaatggggcccgggctcagactggtcacggggggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacggcagctgggccgccggcgcccggagccggctggtggcgggaacgtctcagccaaacctggagcgcccccccagccggctgtctccgccagaggcggctttccaaaggatgctggcgatggagctgcggagccctgaccatccccgagcagaataccctgacttctctccctccccagggccggtggctggactctgaacaactcccttcagtaaaggggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggtggtgttacatgtccatttcatgttttgggggcttttagccccacaaaacaccttcagtagagccttgattaaaaggaaacctgcagactctccaaataaaaaaagaagaaaaaaagaaaagaaagaaggaagagaagaaaaatagaaaacaaaaaagaagg

SEQ ID NO: 419851 - DNA, 1595 bp, Homo sapiens
ccgcgtcttattccttctaatctctcccccgccccttgtcttgcgcctgccttcctaacagccttcagttccccttctcccgtcagaccttcctgacctcccacctggttctctaggggcagggtggacaggaagcagctcagcccagcctgggagaggccaagggctgcctcctatcagagagcgcctgctcgctgtgcccccgggttatgacgacccccaataaaggaaacaaggccttgaaggtgaagcgggagccgggtgagaatggcaccagcctgacggatgaggagctggtgaccatgtcggtgcgggagctgaaccagcacctgcggggcctgtccaaggaggagatcgtccagctgaagcagcgccggcgcacgctcaagaaccgcggctacgctgccagctgccgcgtgaagcgggtgacgcagaaggaggagctggagaagcagaaggcggagctgcagcaggaggtggagaagctggcctcagagaacgccagcatgaagctggagctcgacgcgctgcgctccaagtacgaggcgctgcagaccttcgcccggacggtggcccgcagccccgtggcgccagcccggggcccccttgccgccggcctggggcccctcgtcccaggcaaggtggccgccaccagcgtcatcacaatagtaaagtccaagacggatgcccgatcgtagggacgcgcgtctgcccaggcgggtctttgcggggccactaggcacatggcgaatttggctgccctgtccctctgtttccttctcttctctttcctccctctcttccccacccttctctcttccctgcaaagcacaacctgtaccccaggggcgccgggctgagcccctttgatctcgtcattgtcgtcgtgtgttttgtatgttgggattggtcagttcggcggtgacgtggggtcgccccaaccccttttgtaccagggccatgcaggcttggagtccagagttggtgctgtgggaacggactagagagagttgcgggagagagaaggagcaggcacgctgggcctcgcgtgtccccgagcagtgagggtcccagtgttccctccactcccgagtggccacaggctcgcgggctgggaaggattcactctctttagccccaggggagcagctcagcttagcccagcatgaagagatgggctctgctctgagagtagggcgggcttgaaggccctgatgggtggaccaccagcctgggcgcagtggtgctgggggcgtgcagctgggcccaggggctgtgcactcaggcctgacccgttgcactgaacaagaccaaatcgctggttgtgcgcttaacgtgagggtgggtccagtgtgccctgcgatgggtcccgtgtcactgtttacatgacctatttgtgtggttatatagccctttatttaaaagagagaagttccttttacaaagttattaaattaattatatgtttaaaagttaaagaaaaaagagctgcagagtatttataaaactgtcttttagaaaaaaaacaagcaagaagaccatttgaccatatgaatggaaaagggaagaaagtataatagaaactttgctagtta

SEQ ID NO: 419852 - DNA, 1722 bp, Homo sapiens
ccgcctggtccggcccggccttcccagtgcgctcggcccggcccgcgcaggcggcgagtcctccgagccccgggcccggacccctcgcgccggtccctgccccgcgcggcctcggagcgcgcgcggccccgccccgccccggcctcggcccgccgggcccgcagtgtgagagcgcctgctcgctgtgcccccgggttatgacgacccccaataaaggaaacaaggccttgaaggtgaagcgggagccgggtgagaatggcaccagcctgacggatgaggagctggtgaccatgtcggtgcgggagctgaaccagcacctgcggggcctgtccaaggaggagatcgtccagctgaagcagcgccggcgcacgctcaagaaccgcggctacgctgccagctgccgcgtgaagcgggtgacgcagaaggaggagctggagaagcagaaggcggagctgcagcaggaggtggagaagctggcctcagagaacgccagcatgaagctggagctcgacgcgctgcgctccaagtacgaggcgctgcagaccttcgcccggacggtggcccgcagccccgtggcgccagcccggggcccccttgccgccggcctggggcccctcgtcccaggcaaggtggccgccaccagcgtcatcacaatagtaaagtccaagacggatgcccgatcgtagggacgcgcgtctgcccaggcgggtctttgcggggccactaggcacatggcgaatttggctgccctgtccctctgtttccttctcttctctttcctccctctcttccccacccttctctcttccctgcaaagcacaacctgtaccccaggggcgccgggctgagcccctttgatctcgtcattgtcgtcgtgtgttttgtatgttgggattggtcagttcggcggtgacgtggggtcgccccaaccccttttgtaccagggccatgcaggcttggagtccagagttggtgctgtgggaacggactagagagagttgcgggagagagaaggagcaggcacgctgggcctcgcgtgtccccgagcagtgagggtcccagtgttccctccactcccgagtggccacaggctcgcgggctgggaaggattcactctctttagccccaggggagcagctcagcttagcccagcatgaagagatgggctctgctctgagagtagggcgggcttgaaggccctgatgggtggaccaccagcctgggcgcagtggtgctgggggcgtgcagctgggcccaggggctgtgcactcaggcctgacccgttgcactgaacaagaccaaatcgctggttgtgcgcttaacgtgagggtgggtccagtgtgccctgcgatgggtcccgtgtcactgtttacatgacctatttgtgtggttatatagccctttatttaaaagagagaagttccttttacaaagttattaaattaattatatgtttaaaagttaaagaaaaaagagctgcagagtatttataaaactgtcttttagaaaaaaaacaagcaagaagaccatttgaccatatgaatggaaaagggaagaaagtataatagaaactttgctagttaaaaaaaaaagaaaaaaaaagaaaaaaaatccctttcttgtaaacttacggacacctctttgtggctgttggagtttagtttttatatacacagagttatcagacattatttataaaacttagtttaaaaaaaagacaaa

SEQ ID NO: 419853 - DNA, 1583 bp, Homo sapiens
ccgcctggtccggcccggccttcccagtgcgctcggcccggcccgcgcaggcggcgagtcctccgagccccgggcccggacccctcgcgccggtccctgccccgcgcggcctcggagcgcgcgcggccccgccccgccccggcctcggcccgccgggcccgcagtgtgagagcgcctgctcgctgtgcccccgggttatgacgacccccaataaaggaaacaaggccttgaaggtgaagcgggagccgggtgagaatggcaccagcctgacggatgaggagctggtgaccatgtcggtgcgggagctgaaccagcacctgcggggcctgtccaaggaggagatcgtccagctgaagcagcgccggcgcacgctcaagaaccgcggctacgctgccagctgccgcgtgaagcgggtgacgcagaaggaggagctggagaagcagaaggcggagctgcagcaggaggtggagaagctggcctcagagaacgccagcatgaagctggagctcgacgcgctgcgctccaagtacgaggcgctgcagaccttcgcccggacggtggcccgcagccccgtggcgccagcccggggcccccttgccgccggcctggggcccctcgtcccaggcaaggtggccgccaccagcgtcatcacaatagtaaagtccaagacggatgcccgatcgtagggacgcgcgtctgcccaggcgggtctttgcggggccactaggcacatggcgaatttggctgccctgtccctctgtttccttctcttctctttcctccctctcttccccacccttctctcttccctgcaaagcacaacctgtaccccaggggcgccgggctgagcccctttgatctcgtcattgtcgtcgtgtgttttgtatgttgggattggtcagttcggcggtgacgtggggtcgccccaaccccttttgtaccagggccatgcaggcttggagtccagagttggtgctgtgggaacggactagagagagttgcgggagagagaaggagcaggcacgctgggcctcgcgtgtccccgagcagtgagggtcccagtgttccctccactcccgagtggccacaggctcgcgggctgggaaggattcactctctttagccccaggggagcagctcagcttagcccagcatgaagagatgggctctgctctgagagtagggcgggcttgaaggccctgatgggtggaccaccagcctgggcgcagtggtgctgggggcgtgcagctgggcccaggggctgtgcactcaggcctgacccgttgcactgaacaagaccaaatcgctggttgtgcgcttaacgtgagggtgggtccagtgtgccctgcgatgggtcccgtgtcactgtttacatgacctatttgtgtggttatatagccctttatttaaaagagagaagttccttttacaaagttattaaattaattatatgtttaaaagttaaagaaaaaagagctgcagagtatttataaaactgtcttttagaaaaaaaacaagcaagaagaccatttgaccatatgaatggaaaagggaagaaagtataatagaaactttgctagtta

SEQ ID NO: 419854 - DNA, 380 bp, Homo sapiens
  misc_feature (22)..(22): n is a, c, g, or t
tcgtgccgaattcggcacgacngaaacctcgaggagctgggctagatacttcgagagtagccctgtcttgtcccctcctacccccagattagcaccacccctctcactcttgggttggatgctatgggaattacaacccatcactcccaatgcctccctttcctggaggagcctgctgcattctcctgctgagggatcccagagagggcaggtgcccaccccacaggccctttcctggaccatggagccaggtgaaacctgtctggccccttacccattgggttcttactccttcacaacggtcagcactcctctcccagcccccctgcccactgttctcaataaaatgtgagtggtgagaggcctctgcaggaatgctt

SEQ ID NO: 419855 - DNA, 952 bp, Homo sapiens
ggcccaagagtctgcatttctgacagagtcctaggtgatgcccatgttgccagtccctgtaccctcattgagtaggaagaagctagagctcataaggtccattcatctgtgctatatcattacaccctggaaactaccttgtaggtattattataatgctcacttttcaaacgggaaacagatgtaaagtgaagcagttggctcaaaggttcacagcaagttaatgttaggactggtactagtattagctcctttctttcagtgcaaccaccaaggacttgttggatgccaggcactgtgctaggtgctgtgggtattcagctgaccaaggaagaaggcacattctcccccaaacaaggcttccctgtcccatggtgtaggatttctctgcaaccctgtgtagcaacaccactgccaggatcctggagtggcatgtggctgactcagagatgagtgccctgccattatcagctcctggtactggaggccccagcctgctataagccttggccctgctctggccatactgagaaaaattctctcagtaatctgagatggctgccatggtggctgcctccctgttccaggccttctgctctgaatgggctgaaagggatgcaactgaaaataggtcagagctgtatttccagaggagaaagttatggagggtgctaaccactctccatgaactcacagaggcagaggcctctcctaagagtgaggcatgtgggagtgaggctggacagcctcctggaagctctcggagctatgtcttctgttcctttttatggccatcctatccctctgccctctcagggaaaggggctgtttgccacacagctcatccggaagggggagaccatcttcgtagaacggcccctggtggctgcacagtttctctggaatgcactttatcgctaccgaggtgagtacatctctcctactcctcatg

SEQ ID NO: 419856 - DNA, 432 bp, Homo sapiens
gctgctcggggcggggctagggggctttgctgctgtatccctggaacggtgggcggggatgtgccgggcagagagaactgaggtgtaaaagagggagtcctcacgaacttcatgtgtgagatttgggtgaggggatgaggagagaggccaagatccttcacgagggtccttggagtgctgaggaatttggaccagatcccaatgcctccctttcctggaggagcctgctgcattctcctgctgagggatcccagagagggcaggtgcccaccccacaggccctttcctggaccatggagccaggtgaaacctgtctggccccttacccattgggttcttactccttcacaacggtcagcactcctctcccagcccccctgcccactgttctcaataaaatgtgagtggtgagaggcctctgcaggaatgctt

SEQ ID NO: 419857 - DNA, 407 bp, Homo sapiens
gctgctcggggcggggctagggggctttgctgctgtatccctggaacggtgggcggggatgtgccgggcagagagaactgaggtgtaaaagagggagtcctcacgaacttcatgtgtgagatttgggtgaggggatgaggagagaggccaagatccttcacgagggtccttggagtgctgaggaatttggaccagagtccaaaggccgtgggggcattgggagagtttttagcaggaaggtgacgtgattttgtcgtttttattgtgttccaaaagttcattgtagaaaaaaatacaaaatgcatgtaaggaaagaaaatacaaaaatcacccatacttctatacttgtgcaaagatgagtacgttaaaattacatttttagaaactgctttttgatgcagcagtga

SEQ ID NO: 419858 - DNA, 2426 bp, Homo sapiens
gtcataaggcggaggcgcgcccaagatggcggcctccatgtgcgacgtgttctccttctgcgtgggcgtggcgggccgcgcgcgggtctccgtggaagtccgtttcgtgagcagcgccaagggaaaggggctgtttgccacacagctcatccggaagggggagaccatcttcgtagaacggcccctggtggctgcacagtttctctggaatgcactttatcgctaccgagcctgtgaccactgccttagggcactagagaaggcagaggagaatgcccagaggctgaccgggaaaccaggccaggttctgcctcacccagagctgtgcactgtgcgcaaagacctccaccagaactgtccccattgccaagtgatgtactgcagtgcagaatgtcggttggcagccactgagcaataccaccaggtcctgtgcccaggcccctcccaggatgaccccttgcatcctctcaataagcttcaggaggcatggaggagtattcactacccacctgagactgcaagcatcatgttgatggctaggatggtggccacagtgaagcaggcgaaggacaaggaccgttggatcagactcttttcccagttttgtaacaaaacagccaatgaagaggaggaaattgtccataaacttctgggagacaaattcaagggccaactggaacttctgcggagactcttcacagaggccctctatgaggaagcagtcagccagtggttcactccagatggattccggtctctctttgctcttgttgggaccaatggccaaggaatcgggaccagctccctaagccagtgggtccatgcctgtgacactctggagttgaagcctcaggaccgtgagcagcttgacgccttcattgaccagctatacaaggacatcgaggcaggaaatttgtatcagctacttggactgctgtcagcgggagcgcagccgccacagccgccacaagatcctcagggagaactatctatttgtctgttcctgtcccaaatgcctggcagaggctgatgaacccaatgtgacctcagaagaggaagaggaagaggaggaggaggaggaaggagagccagaagatgcagagctgggggatgagatgactgatgtgtgatgttgccctgcccagaaagggccctgccctagaccctgccagaaaagggggctcttcccccagagaagtggcttggagggaacttcccactcccattgcctgctttccccattccagccctctctgctagagggtaggagagagcctggatctctggccccaacccccaccagacctcatgccctggacactgctgctgagttggctcagactctgcactggcactgagcctttcacaactggcctccccttgaggttcctccactctagggtttgaggggctggaatcagggccagggcctaacagtgtttcttcccctcggccccacggcccatactcaccccttcacctgaggcttctcccctctcaacttgctgttgatttcttttgaggggtaaaagaaagaccgagttcattgaagcagagatgggaggtggtgaggcgtcctcacctccccccaccacagctgtggctggtaaggcaactgcttgaccactggcccagcaagcagaggcgggcaggaggatctgggcatcctgagccccttccctgaggctgtctcctgggaatgctggaccagggggattacttcccccacccacacccccatttggacatctggggaagtggagattaacccctcccccagactcgtgccttgcctctcaggacctggcacagtggctggccttatggagtatggaaaaggcctctgccttcctcaggagggacacatagtgggtcatcaccctttctcacacctgcttcccaatgagcactcagcagcatggctgagacctggggcttgacaggcctgcgctccttagattaggatgctctggtattcctggggccagttaaaatgggtcagtgaggggctctcctggcctcaatctccatctttagggtctccacagactaacattgaagtcttccagaaacctcgaggagctgggctagatacttcgagagtagccctgtcttgtcccctcctacccccagattagcaccacccctctcactcttgggttggatgctatgggaattacaacccatcactcccaatgcctccctttcctggaggagcctgctgcattctcctgctgagggatcccagagagggcaggtgcccaccccacaggccctttcctggaccatggagccaggtgaaacctgtctggccccttacccattgggttcttactccttcacaacggtcagcactcctctcccagcccccctgcccactgttctcaataaaatgtgagtggtgagaggcctctgcaggaatgctt

SEQ ID NO: 419859 - DNA, 3273 bp, Homo sapiens
ggcccaagagtctgcatttctgacagagtcctaggtgatgcccatgttgccagtccctgtaccctcattgagtaggaagaagctagagctcataaggtccattcatctgtgctatatcattacaccctggaaactaccttgtaggtattattataatgctcacttttcaaacgggaaacagatgtaaagtgaagcagttggctcaaaggttcacagcaagttaatgttaggactggtactagtattagctcctttctttcagtgcaaccaccaaggacttgttggatgccaggcactgtgctaggtgctgtgggtattcagctgaccaaggaagaaggcacattctcccccaaacaaggcttccctgtcccatggtgtaggatttctctgcaaccctgtgtagcaacaccactgccaggatcctggagtggcatgtggctgactcagagatgagtgccctgccattatcagctcctggtactggaggccccagcctgctataagccttggccctgctctggccatactgagaaaaattctctcagtaatctgagatggctgccatggtggctgcctccctgttccaggccttctgctctgaatgggctgaaagggatgcaactgaaaataggtcagagctgtatttccagaggagaaagttatggagggtgctaaccactctccatgaactcacagaggcagaggcctctcctaagagtgaggcatgtgggagtgaggctggacagcctcctggaagctctcggagctatgtcttctgttcctttttatggccatcctatccctctgccctctcagggaaaggggctgtttgccacacagctcatccggaagggggagaccatcttcgtagaacggcccctggtggctgcacagtttctctggaatgcactttatcgctaccgagcctgtgaccactgccttagggcactagagaaggcagaggagaatgcccagaggctgaccgggaaaccaggccaggttctgcctcacccagagctgtgcactgtgcgcaaagacctccaccagaactgtccccattgccaagtgatgtactgcagtgcagaatgtcggttggcagccactgagcaataccaccaggtcctgtgcccaggcccctcccaggatgaccccttgcatcctctcaataagcttcaggaggcatggaggagtattcactacccacctgagactgcaagcatcatgttgatggctaggatggtggccacagtgaagcaggcgaaggacaaggaccgttggatcagactcttttcccagttttgtaacaaaacagccaatgaagaggaggaaattgtccataaacttctgggagacaaattcaagggccaactggaacttctgcggagactcttcacagaggccctctatgaggaagcagtcagccagtggttcactccagatggattccggtctctctttgctcttgttgggaccaatggccaaggaatcgggaccagctccctaagccagtgggtccatgcctgtgacactctggagttgaagcctcaggaccgtgagcagcttgacgccttcattgaccagctatacaaggacatcgaggcagcaactggagagtttcttaactgtgaaggatctggcctctttgtgcttcagagctgctgcaaccacagttgtgtgcccaatgcagagacctcctttccagaaaacaacttccttttgcatgtcactgctctggaggatattaagccaggagaggaaatttgtatcagctacttggactgctgtcagcgggagcgcagccgccacagccgccacaagatcctcagggagaactatctatttgtctgttcctgtcccaaatgcctggcagaggctgatgaacccaatgtgacctcagaagaggaagaggaagaggaggaggaggaggaaggagagccagaagatgcagagctgggggatgagatgactgatgtgtgatgttgccctgcccagaaagggccctgccctagaccctgccagaaaagggggctcttcccccagagaagtggcttggagggaacttcccactcccattgcctgctttccccattccagccctctctgctagagggtaggagagagcctggatctctggccccaacccccaccagacctcatgccctggacactgctgctgagttggctcagactctgcactggcactgagcctttcacaactggcctccccttgaggttcctccactctagggtttgaggggctggaatcagggccagggcctaacagtgtttcttcccctcggccccacggcccatactcaccccttcacctgaggcttctcccctctcaacttgctgttgatttcttttgaggggtaaaagaaagaccgagttcattgaagcagagatgggaggtggtgaggcgtcctcacctccccccaccacagctgtggctggtaaggcaactgcttgaccactggcccagcaagcagaggcgggcaggaggatctgggcatcctgagccccttccctgaggctgtctcctgggaatgctggaccagggggattacttcccccacccacacccccatttggacatctggggaagtggagattaacccctcccccagactcgtgccttgcctctcaggacctggcacagtggctggccttatggagtatggaaaaggcctctgccttcctcaggagggacacatagtgggtcatcaccctttctcacacctgcttcccaatgagcactcagcagcatggctgagacctggggcttgacaggcctgcgctccttagattaggatgctctggtattcctggggccagttaaaatgggtcagtgaggggctctcctggcctcaatctccatctttagggtctccacagactaacattgaagtcttccagaaacctcgaggagctgggctagatacttcgagagtagccctgtcttgtcccctcctacccccagattagcaccacccctctcactcttgggttggatgctatgggaattacaacccatcactcccaatgcctccctttcctggaggagcctgctgcattctcctgctgagggatcccagagagggcaggtgcccaccccacaggccctttcctggaccatggagccaggtgaaacctgtctggccccttacccattgggttcttactccttcacaacggtcagcactcctctcccagcccccctgcccactgttctcaataaaatgtgagtggtgagaggcctctgcaggaatgctt

SEQ ID NO: 419860 - DNA, 2482 bp, Homo sapiens
atttactcactttccaaacctttatgaaacactagaatggtgcctggcacatagcagctgctctgtagggctgtgaaagggatagatgtggcctctgctctcaagatattgttgtgtctggctctcaccgtcagcctgtgaccactgccttagggcactagagaaggcagaggagaatgcccagaggctgaccgggaaaccaggccaggttctgcctcacccagagctgtgcactgtgcgcaaagacctccaccagaactgtccccattgccaagtgatgtactgcagtgcagaatgtcggttggcagccactgagcaataccaccaggtcctgtgcccaggcccctcccaggatgaccccttgcatcctctcaataagcttcaggaggcatggaggagtattcactacccacctgagactgcaagcatcatgttgatggctaggatggtggccacagtgaagcaggcgaaggacaaggaccgttggatcagactcttttcccagttttgtaacaaaacagccaatgaagaggaggaaattgtccataaacttctgggagacaaattcaagggccaactggaacttctgcggagactcttcacagaggccctctatgaggaagcagtcagccagtggttcactccagatggattccggtctctctttgctcttgttgggaccaatggccaaggaatcgggaccagctccctaagccagtgggtccatgcctgtgacactctggagttgaagcctcaggaccgtgagcagcttgacgccttcattgaccagctatacaaggacatcgaggcagcaactggagagtttcttaactgtgaaggatctggcctctttgtgcttcagagctgctgcaaccacagttgtgtgcccaatgcagagacctcctttccagaaaacaacttccttttgcatgtcactgctctggaggatattaagccaggagaggaaatttgtatcagctacttggactgctgtcagcgggagcgcagccgccacagccgccacaagatcctcagggagaactatctatttgtctgttcctgtcccaaatgcctggcagaggctgatgaacccaatgtgacctcagaagaggaagaggaagaggaggaggaggaggaaggagagccagaagatgcagagctgggggatgagatgactgatgtgtgatgttgccctgcccagaaagggccctgccctagaccctgccagaaaagggggctcttcccccagagaagtggcttggagggaacttcccactcccattgcctgctttccccattccagccctctctgctagagggtaggagagagcctggatctctggccccaacccccaccagacctcatgccctggacactgctgctgagttggctcagactctgcactggcactgagcctttcacaactggcctccccttgaggttcctccactctagggtttgaggggctggaatcagggccagggcctaacagtgtttcttcccctcggccccacggcccatactcaccccttcacctgaggcttctcccctctcaacttgctgttgatttcttttgaggggtaaaagaaagaccgagttcattgaagcagagatgggaggtggtgaggcgtcctcacctccccccaccacagctgtggctggtaaggcaactgcttgaccactggcccagcaagcagaggcgggcaggaggatctgggcatcctgagccccttccctgaggctgtctcctgggaatgctggaccagggggattacttcccccacccacacccccatttggacatctggggaagtggagattaacccctcccccagactcgtgccttgcctctcaggacctggcacagtggctggccttatggagtatggaaaaggcctctgccttcctcaggagggacacatagtgggtcatcaccctttctcacacctgcttcccaatgagcactcagcagcatggctgagacctggggcttgacaggcctgcgctccttagattaggatgctctggtattcctggggccagttaaaatgggtcagtgaggggctctcctggcctcaatctccatctttagggtctccacagactaacattgaagtcttccagaaacctcgaggagctgggctagatacttcgagagtagccctgtcttgtcccctcctacccccagattagcaccacccctctcactcttgggttggatgctatgggaattacaacccatcactcccaatgcctccctttcctggaggagcctgctgcattctcctgctgagggatcccagagagggcaggtgcccaccccacaggccctttcctggaccatggagccaggtgaaacctgtctggccccttacccattgggttcttactccttcacaacggtcagcactcctctcccagcccccctgcccactgttctcaataaaatgtgagtggtgagaggcctctgcaggaatgctt

SEQ ID NO: 419861 - DNA, 2128 bp, Homo sapiens
ctccttcgatttggctctctatatagtgaagcagaacgtcacaagcgtgatgtcgcacactaatagggaacgtgagcagcgttcagaccgtcgtgaatagtgtatcaccctagggatgatgtgtgtgccatggtaatcctgctcagtacgatgaggaaccgagtaggacgttggtgtatgtgcttggtagggagccattgcctaagctctgtctgtgggattatggcgaatatgggggacctctagagtcgccggggctctatagcttgcagttggccggtgtttcacaccgtatggattgcggtcgcggttagcacttgcagagagcaatggtcaaggaatcgggaccagctccctaagccagtgggtccatgcctgtgacactctggagttgaagcctcaggaccgtgagcagcttgacgccttcattgaccagctatacaaggacatcgaggcagcaactggagagtttcttaactgtgaaggatctggcctctttgtgcttcagagctgctgcaaccacagttgtgtgcccaatgcagagacctcctttccagaaaacaacttccttttgcatgtcactgctctggaggatattaagccaggagaggaaatttgtatcagctacttggactgctgtcagcgggagcgcagccgccacagccgccacaagatcctcagggagaactatctatttgtctgttcctgtcccaaatgcctggcagaggctgatgaacccaatgtgacctcagaagaggaagaggaagaggaggaggaggaggaaggagagccagaagatgcagagctgggggatgagatgactgatgtgtgatgttgccctgcccagaaagggccctgccctagaccctgccagaaaagggggctcttcccccagagaagtggcttggagggaacttcccactcccattgcctgctttccccattccagccctctctgctagagggtaggagagagcctggatctctggccccaacccccaccagacctcatgccctggacactgctgctgagttggctcagactctgcactggcactgagcctttcacaactggcctccccttgaggttcctccactctagggtttgaggggctggaatcagggccagggcctaacagtgtttcttcccctcggccccacggcccatactcaccccttcacctgaggcttctcccctctcaacttgctgttgatttcttttgaggggtaaaagaaagaccgagttcattgaagcagagatgggaggtggtgaggcgtcctcacctccccccaccacagctgtggctggtaaggcaactgcttgaccactggcccagcaagcagaggcgggcaggaggatctgggcatcctgagccccttccctgaggctgtctcctgggaatgctggaccagggggattacttcccccacccacacccccatttggacatctggggaagtggagattaacccctcccccagactcgtgccttgcctctcaggacctggcacagtggctggccttatggagtatggaaaaggcctctgccttcctcaggagggacacatagtgggtcatcaccctttctcacacctgcttcccaatgagcactcagcagcatggctgagacctggggcttgacaggcctgcgctccttagattaggatgctctggtattcctggggccagttaaaatgggtcagtgaggggctctcctggcctcaatctccatctttagggtctccacagactaacattgaagtcttccagaaacctcgaggagctgggctagatacttcgagagtagccctgtcttgtcccctcctacccccagattagcaccacccctctcactcttgggttggatgctatgggaattacaacccatcactcccaatgcctccctttcctggaggagcctgctgcattctcctgctgagggatcccagagagggcaggtgcccaccccacaggccctttcctggaccatggagccaggtgaaacctgtctggccccttacccattgggttcttactccttcacaacggtcagcactcctctcccagcccccctgcccactgttctcaataaaatgtgagtggtgagaggcctctgcaggaatgctt

SEQ ID NO: 419862 - DNA, 866 bp, Homo sapiens
gtcataaggcggaggcgcgcccaagatggcggcctccatgtgcgacgtgttctccttctgcgtgggcgtggcgggccgcgcgcgggtctccgtggaagtccgtttcgtgagcagcgccaagggaaaggggctgtttgccacacagctcatccggaagggggagaccatcttcgtagaacggcccctggtggctgcacagtttctctggaatgcactttatcgctaccgagcctgtgaccactgccttagggcactagagaaggcagaggagaatgcccagaggctgaccgggaaaccaggccaggttctgcctcacccagagctgtgcactgtgcgcaaagacctccaccagaactgtccccattgccaagtgatgtactgcagtgcagaatgtcggttggcagccactgagcaataccaccaggtcctgtgcccaggcccctcccaggatgaccccttgcatcctctcaataagcttcaggaggcatggaggagtattcactacccacctgagactgcaagcatcatgttgatggctaggatggtggccacagtgaagcaggcgaaggacaaggaccgttggatcagactcttttcccagttttgtaacaaaacagccaatgaagaggaggaaattgtccataaacttctgggagacaaattcaagggccaactggaacttctgcggagactcttcacagaggccctctatgaggaagcagtcagccagtggttcactccagatggattccggtctctctttgctcttgttgggaccaatggccaaggaatcgggaccaggatcggtagaatgttccagagctattgaagttactctcaggggtgggaaactgaggaaggtagcc

SEQ ID NO: 419863 - DNA, 2172 bp, Homo sapiens
ggcacgaggtgcaaaacagccgtcagaagttgggttaggacagttgtagcactgcaggctatgacctgaatggcagaagacagccaggacgagcagcagcccgaacaggacagacccaacaattgacggctgttttgcagtcagaagttgggttaggacagttgtagcactgcaggctatgacctgaatggcagaagacagccaggacgagcagcagcccgaacaggacagaccctccttggattcccattgtgattgtccacagaacctggcggcgcccaggatcccttcacagaggccctctatgaggaagcagtcagccagtggttcactccagatggattccggtctctctttgctcttgttgggaccaatggccaaggaatcgggaccagctccctaagccagtgggtccatgcctgtgacactctggagttgaagcctcaggaccgtgagcagcttgacgccttcattgaccagctatacaaggacatcgaggcagcaactggagagtttcttaactgtgaaggatctggcctctttgtgcttcagagctgctgcaaccacagttgtgtgcccaatgcagagacctcctttccagaaaacaacttccttttgcatgtcactgctctggaggatattaagccaggagaggaaatttgtatcagctacttggactgctgtcagcgggagcgcagccgccacagccgccacaagatcctcagggagaactatctatttgtctgttcctgtcccaaatgcctggcagaggctgatgaacccaatgtgacctcagaagaggaagaggaagaggaggaggaggaggaaggagagccagaagatgcagagctgggggatgagatgactgatgtgtgatgttgccctgcccagaaagggccctgccctagaccctgccagaaaagggggctcttcccccagagaagtggcttggagggaacttcccactcccattgcctgctttccccattccagccctctctgctagagggtaggagagagcctggatctctggccccaacccccaccagacctcatgccctggacactgctgctgagttggctcagactctgcactggcactgagcctttcacaactggcctccccttgaggttcctccactctagggtttgaggggctggaatcagggccagggcctaacagtgtttcttcccctcggccccacggcccatactcaccccttcacctgaggcttctcccctctcaacttgctgttgatttcttttgaggggtaaaagaaagaccgagttcattgaagcagagatgggaggtggtgaggcgtcctcacctccccccaccacagctgtggctggtaaggcaactgcttgaccactggcccagcaagcagaggcgggcaggaggatctgggcatcctgagccccttccctgaggctgtctcctgggaatgctggaccagggggattacttcccccacccacacccccatttggacatctggggaagtggagattaacccctcccccagactcgtgccttgcctctcaggacctggcacagtggctggccttatggagtatggaaaaggcctctgccttcctcaggagggacacatagtgggtcatcaccctttctcacacctgcttcccaatgagcactcagcagcatggctgagacctggggcttgacaggcctgcgctccttagattaggatgctctggtattcctggggccagttaaaatgggtcagtgaggggctctcctggcctcaatctccatctttagggtctccacagactaacattgaagtcttccagaaacctcgaggagctgggctagatacttcgagagtagccctgtcttgtcccctcctacccccagattagcaccacccctctcactcttgggttggatgctatgggaattacaacccatcactcccaatgcctccctttcctggaggagcctgctgcattctcctgctgagggatcccagagagggcaggtgcccaccccacaggccctttcctggaccatggagccaggtgaaacctgtctggccccttacccattgggttcttactccttcacaacggtcagcactcctctcccagcccccctgcccactgttctcaataaaatgtgagtggtgagaggcctctgcaggaatgctt

SEQ ID NO: 419864 - DNA, 2578 bp, Homo sapiens
gtcataaggcggaggcgcgcccaagatggcggcctccatgtgcgacgtgttctccttctgcgtgggcgtggcgggccgcgcgcgggtctccgtggaagtccgtttcgtgagcagcgccaagggaaaggggctgtttgccacacagctcatccggaagggggagaccatcttcgtagaacggcccctggtggctgcacagtttctctggaatgcactttatcgctaccgagcctgtgaccactgccttagggcactagagaaggcagaggagaatgcccagaggctgaccgggaaaccaggccaggttctgcctcacccagagctgtgcactgtgcgcaaagacctccaccagaactgtccccattgccaagtgatgtactgcagtgcagaatgtcggttggcagccactgagcaataccaccaggtcctgtgcccaggcccctcccaggatgaccccttgcatcctctcaataagcttcaggaggcatggaggagtattcactacccacctgagactgcaagcatcatgttgatggctaggatggtggccacagtgaagcaggcgaaggacaaggaccgttggatcagactcttttcccagttttgtaacaaaacagccaatgaagaggaggaaattgtccataaacttctgggagacaaattcaagggccaactggaacttctgcggagactcttcacagaggccctctatgaggaagcagtcagccagtggttcactccagatggattccggtctctctttgctcttgttgggaccaatggccaaggaatcgggaccagctccctaagccagtgggtccatgcctgtgacactctggagttgaagcctcaggaccgtgagcagcttgacgccttcattgaccagctatacaaggacatcgaggcagcaactggagagtttcttaactgtgaaggatctggcctctttgtgcttcagagctgctgcaaccacagttgtgtgcccaatgcagagacctcctttccagaaaacaacttccttttgcatgtcactgctctggaggatattaagccaggagaggaaatttgtatcagctacttggactgctgtcagcgggagcgcagccgccacagccgccacaagatcctcagggagaactatctatttgtctgttcctgtcccaaatgcctggcagaggctgatgaacccaatgtgacctcagaagaggaagaggaagaggaggaggaggaggaaggagagccagaagatgcagagctgggggatgagatgactgatgtgtgatgttgccctgcccagaaagggccctgccctagaccctgccagaaaagggggctcttcccccagagaagtggcttggagggaacttcccactcccattgcctgctttccccattccagccctctctgctagagggtaggagagagcctggatctctggccccaacccccaccagacctcatgccctggacactgctgctgagttggctcagactctgcactggcactgagcctttcacaactggcctccccttgaggttcctccactctagggtttgaggggctggaatcagggccagggcctaacagtgtttcttcccctcggccccacggcccatactcaccccttcacctgaggcttctcccctctcaacttgctgttgatttcttttgaggggtaaaagaaagaccgagttcattgaagcagagatgggaggtggtgaggcgtcctcacctccccccaccacagctgtggctggtaaggcaactgcttgaccactggcccagcaagcagaggcgggcaggaggatctgggcatcctgagccccttccctgaggctgtctcctgggaatgctggaccagggggattacttcccccacccacacccccatttggacatctggggaagtggagattaacccctcccccagactcgtgccttgcctctcaggacctggcacagtggctggccttatggagtatggaaaaggcctctgccttcctcaggagggacacatagtgggtcatcaccctttctcacacctgcttcccaatgagcactcagcagcatggctgagacctggggcttgacaggcctgcgctccttagattaggatgctctggtattcctggggccagttaaaatgggtcagtgaggggctctcctggcctcaatctccatctttagggtctccacagactaacattgaagtcttccagaaacctcgaggagctgggctagatacttcgagagtagccctgtcttgtcccctcctacccccagattagcaccacccctctcactcttgggttggatgctatgggaattacaacccatcactcccaatgcctccctttcctggaggagcctgctgcattctcctgctgagggatcccagagagggcaggtgcccaccccacaggccctttcctggaccatggagccaggtgaaacctgtctggccccttacccattgggttcttactccttcacaacggtcagcactcctctcccagcccccctgcccactgttctcaataaaatgtgagtggtgagaggcctctgcaggaatgctt

SEQ ID NO: 419865 - DNA, 2677 bp, Homo sapiens
gtcataaggcggaggcgcgcccaagatggcggcctccatgtgcgacgtgttctccttctgcgtgggcgtggcgggccgcgcgcgggtctccgtggaagtccgtttcgtgagcagcgccaagggaaaggggctgtttgccacacagctcatccggaagggggagaccatcttcgtagaacggcccctggtggctgcacagtttctctggaatgcactttatcgctaccgagaatggtgcctggcacatagcagctgctctgtagggctgtgaaagggatagatgtggcctctgctctcaagatattgttgtgtctggctctcaccgtcagcctgtgaccactgccttagggcactagagaaggcagaggagaatgcccagaggctgaccgggaaaccaggccaggttctgcctcacccagagctgtgcactgtgcgcaaagacctccaccagaactgtccccattgccaagtgatgtactgcagtgcagaatgtcggttggcagccactgagcaataccaccaggtcctgtgcccaggcccctcccaggatgaccccttgcatcctctcaataagcttcaggaggcatggaggagtattcactacccacctgagactgcaagcatcatgttgatggctaggatggtggccacagtgaagcaggcgaaggacaaggaccgttggatcagactcttttcccagttttgtaacaaaacagccaatgaagaggaggaaattgtccataaacttctgggagacaaattcaagggccaactggaacttctgcggagactcttcacagaggccctctatgaggaagcagtcagccagtggttcactccagatggattccggtctctctttgctcttgttgggaccaatggccaaggaatcgggaccagctccctaagccagtgggtccatgcctgtgacactctggagttgaagcctcaggaccgtgagcagcttgacgccttcattgaccagctatacaaggacatcgaggcagcaactggagagtttcttaactgtgaaggatctggcctctttgtgcttcagagctgctgcaaccacagttgtgtgcccaatgcagagacctcctttccagaaaacaacttccttttgcatgtcactgctctggaggatattaagccaggagaggaaatttgtatcagctacttggactgctgtcagcgggagcgcagccgccacagccgccacaagatcctcagggagaactatctatttgtctgttcctgtcccaaatgcctggcagaggctgatgaacccaatgtgacctcagaagaggaagaggaagaggaggaggaggaggaaggagagccagaagatgcagagctgggggatgagatgactgatgtgtgatgttgccctgcccagaaagggccctgccctagaccctgccagaaaagggggctcttcccccagagaagtggcttggagggaacttcccactcccattgcctgctttccccattccagccctctctgctagagggtaggagagagcctggatctctggccccaacccccaccagacctcatgccctggacactgctgctgagttggctcagactctgcactggcactgagcctttcacaactggcctccccttgaggttcctccactctagggtttgaggggctggaatcagggccagggcctaacagtgtttcttcccctcggccccacggcccatactcaccccttcacctgaggcttctcccctctcaacttgctgttgatttcttttgaggggtaaaagaaagaccgagttcattgaagcagagatgggaggtggtgaggcgtcctcacctccccccaccacagctgtggctggtaaggcaactgcttgaccactggcccagcaagcagaggcgggcaggaggatctgggcatcctgagccccttccctgaggctgtctcctgggaatgctggaccagggggattacttcccccacccacacccccatttggacatctggggaagtggagattaacccctcccccagactcgtgccttgcctctcaggacctggcacagtggctggccttatggagtatggaaaaggcctctgccttcctcaggagggacacatagtgggtcatcaccctttctcacacctgcttcccaatgagcactcagcagcatggctgagacctggggcttgacaggcctgcgctccttagattaggatgctctggtattcctggggccagttaaaatgggtcagtgaggggctctcctggcctcaatctccatctttagggtctccacagactaacattgaagtcttccagaaacctcgaggagctgggctagatacttcgagagtagccctgtcttgtcccctcctacccccagattagcaccacccctctcactcttgggttggatgctatgggaattacaacccatcactcccaatgcctccctttcctggaggagcctgctgcattctcctgctgagggatcccagagagggcaggtgcccaccccacaggccctttcctggaccatggagccaggtgaaacctgtctggccccttacccattgggttcttactccttcacaacggtcagcactcctctcccagcccccctgcccactgttctcaataaaatgtgagtggtgagaggcctctgcaggaatgctt

SEQ ID NO: 419866 - DNA, 1727 bp, Homo sapiens
gtttcttaactgtgaaggatctggcctcattgaccagctatacaaggacatcgaggccaactggagagtttcttaactgtgaaggatctggcctctttgtgcttcagagctgctgcaaccacagttgtgtgcccaatgcagagacctcctttccagaaaacaacttccttttgcatgtcactgctctggaggatattaagccaggagaggaaatttgtatcagctacttggactgctgtcagcgggagcgcagccgccacagccgccacaagatcctcagggagaactatctatttgtctgttcctgtcccaaatgcctggcagaggctgatgaacccaatgtgacctcagaagaggaagaggaagaggaggaggaggaggaaggagagccagaagatgcagagctgggggatgagatgactgatgtgtgatgttgccctgcccagaaagggccctgccctagaccctgccagaaaagggggctcttcccccagagaagtggcttggagggaacttcccactcccattgcctgctttccccattccagccctctctgctagagggtaggagagagcctggatctctggccccaacccccaccagacctcatgccctggacactgctgctgagttggctcagactctgcactggcactgagcctttcacaactggcctccccttgaggttcctccactctagggtttgaggggctggaatcagggccagggcctaacagtgtttcttcccctcggccccacggcccatactcaccccttcacctgaggcttctcccctctcaacttgctgttgatttcttttgaggggtaaaagaaagaccgagttcattgaagcagagatgggaggtggtgaggcgtcctcacctccccccaccacagctgtggctggtaaggcaactgcttgaccactggcccagcaagcagaggcgggcaggaggatctgggcatcctgagccccttccctgaggctgtctcctgggaatgctggaccagggggattacttcccccacccacacccccatttggacatctggggaagtggagattaacccctcccccagactcgtgccttgcctctcaggacctggcacagtggctggccttatggagtatggaaaaggcctctgccttcctcaggagggacacatagtgggtcatcaccctttctcacacctgcttcccaatgagcactcagcagcatggctgagacctggggcttgacaggcctgcgctccttagattaggatgctctggtattcctggggccagttaaaatgggtcagtgaggggctctcctggcctcaatctccatctttagggtctccacagactaacattgaagtcttccagaaacctcgaggagctgggctagatacttcgagagtagccctgtcttgtcccctcctacccccagattagcaccacccctctcactcttgggttggatgctatgggaattacaacccatcactcccaatgcctccctttcctggaggagcctgctgcattctcctgctgagggatcccagagagggcaggtgcccaccccacaggccctttcctggaccatggagccaggtgaaacctgtctggccccttacccattgggttcttactccttcacaacggtcagcactcctctcccagcccccctgcccactgttctcaataaaatgtgagtggtgagaggcctctgcaggaatgctt

SEQ ID NO: 419867 - DNA, 1300 bp, Homo sapiens
gtcataaggcggaggcgcgcccaagatggcggcctccatgtgcgacgtgttctccttctgcgtgggcgtggcgggccgcgcgcgggtctccgtggaagtccgtttcgtgagcagcgccaagggaaaggggctgtttgccacacagctcatccggaagggggagaccatcttcgtagaacggcccctggtggctgcacagtttctctggaatgcactttatcgctaccgagcctgtgaccactgccttagggcactagagaaggcagaggagaatgcccagaggctgaccgggaaaccaggccaggttctgcctcacccagagctgtgcactgtgcgcaaagacctccaccagaactgtccccattgccaagtgatgtactgcagtgcagaatgtcggttggcagccactgagcaataccaccaggtcctgtgcccaggcccctcccaggatgaccccttgcatcctctcaataagcttcaggaggcatggaggagtattcactacccacctgagactgcaagcatcatgttgatggctaggatggtggccacagtgaagcaggcgaaggacaaggaccgttggatcagactcttttcccagttttgtaacaaaacagccaatgaagaggaggaaattgtccataaacttctgggagacaaattcaagggccaactggaacttctgcggagactcttcacagaggccctctatgaggaagcagtcagccagtggttcactccagatggattccggtctctctttgctcttgttgggaccaatggccaaggaatcgggaccagctccctaagccagtgggtccatgcctgtgacactctggagttgaagcctcaggaccgtgagcagcttgacgccttcattgaccagctatacaaggacatcgaggcaggaaatttgtatcagctacttggactgctgtcagcgggagcgcagccgccacagccgccacaagatcctcagggagaactatctatttgtctgttcctgtcccaaatgcctggcagaggctgatgaacccaatgtgacctcagaagaggaagaggaagaggaggaggaggaggaaggagagccagaagatgcagagctgggggatgagatgactgatgtgtgatgtgcccaccccacaggccctttcctggaccatggagccaggtgaaacctgtctggccccttacccattgggttcttactccttcacaacggtcagcactcctctcccagcccccctgcccactgttctcaataaaatgtgagtggtgagaggcctctgcaggaatgctt

SEQ ID NO: 419868 - DNA, 3464 bp, Homo sapiens
gggacgctgcggtgccgctttccctatccagtcctgttcccgcggctccccagcctaccccgggccgaccaagaggtccggcggggtctgcgccgcatcagcgcccgctcgtcaggcctagccctccgcacagccaaggccgaccagacctctagacactccgtcgtcgggtgtggggcggagaagtaaagggcgagttttcttcctagattccagtgggaaccaagaaaaggagttggcagctgtgtaaactggacctggggtgcggcctccgggaacaaaagaggtgataaatgcacagcagccgaggttctgcgtgctcctttggggccactacgaatccccgtgaatcaccccagcccgggcagagggccagaaatgatgaaaatgcagattcatggcttccactccagccctacaagatcaccaaccgtatctggcagtacccaggaatctgcattctcgacaagcgtccgcgccgacggggctagtgaagtttgagaacaattgcttcctacccagccgctccgctatcacctaggtagcacggccgctgcggctgaggctgtgactgcggctgcggctgggccgcgcctcaaccgagcttggtcctttcctttggtcccgccccgctgctcagcgcggattggtggcgggacgcaaatctggcgctgattgggcggcggcagagtcgctcgtgaagattgtagggttcgggtgctctagagtgctaaatttatcttcagaccggcgaccgcgccagccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaaggcttttggttactccccttcccaccccatcccttaattttattcttttgaagagtgcatttcaagctgccaaggtggagagagggattacagaaaggagaacaccttatttcagcttttatttttatgtgataatctacctttaagaaaaggtgtaccatacctgagagcaccaggaagtcgcatgagagatcacctgatacatgaacgtatgatgttccatctgcgcattgatgaataggcagcatttacaaattaactgatgtgttgctgtatatcatctctttgatgattgctcctcttctttgtatcctgtcttataatttcaacacatttgcgatactcaatgtctattctaaattaaccatgttttgtaccacaaactcattgcccatggatctgttgctgaaacaaggaagtcttaaacaagaagtggaatctttctgttatcagattgtgtctgaatcaaatgatcagaaggttggaatattacaaagtgaagataagcagttgcaaccttcagtttctaaaaaatcagaaggtgagctttccagggtcaaatttatatccaattccaacaaaataacatttagtaaaaaaccaaaaagaagaaaatatgatgaaagttatttgtcttttggatttacttacttcggaaatagagatgcacctcatgctcagtgtgtattatgtaagaaaattttatcaaatagctctttagcccctagtaagcttcgaagacatttggaaactaaacatgctgcatataaagacaaagacataagctttttcaagcaacatctcgattcacctgaaaataataaacccccaacacctaaaattgtgaatacagataatgaaagtgctacagaagcatcatacaatgtaagttaccatatagcgctgagtggagaggctcatactattggagaattgcttatcaaaccttgtgcaaaagatgtagtgatgcggatgtttgatgaacaatatagtaaaaaaatagatgcagtacagctatcaaacagtactgttgcacgtcgaattaaggatctagctgctgacattgaagaagagcttgtttgtagactgaaaatttgcgatgggttttcactgcaactagatgaatcagctgatgtttcaggacttgctgtgctgcttgtgtttgttcgttataggtttaataagtctattgaggaagacctactcctgtgtgaatctttgcaaagtaatgctaccggtgaagaaatattcaactgtatcaacagttttatgcagaaacatgaaattgaatgggaaaaatgtgttgatgtttgtagtgatgcttctagggcagtggatgggaaaattgccgaagctgtcaccttaataaaatatgtggctcccgaaagcaccagtagtcactgcctattatacagacatgcactggcagttaaaataatgcctacatctctaaaaaatgtgctagaccaggcagtacaaatcatcaattatattaaagctcgaccacatcaatccagactattaaaaattttatgtgaggaaatgggtgctcagcacacagcacttcttctaaatacagaggtgaggtggctttctcgaggtaaagttcttgtaagactttttgaacttcgtcgtgaacttttggttttcatggattctgcttttcgactatctgattgtttaacaaattcatcttggctgctaagacttgcatatcttgcagatatttttactaaattaaatgaagttaatttgtcaatgcaaggaaaaaatgtgaccgtttttacagtatttgataaaatgtcgtcattgttaagaaaattggaattttgggcctcatctgtagaagaagaaaactttgattgttttcctacactcagtgattttttgactgaaattaattctacagttgataaagatatttgcagtgccattgtgcagcacctaaggggtttgcgcgctactctgttaaaatactttcctgtaacaaatgacaataatgcttgggttagaaatccatttacagttactgttaaaccagcttcattagtagcacgggactatgagagcctgattgatttaacatctgattctcaagtgaagcaaaattttagtgaactttcactaaatgatttttggagtagcctaattcaggaatacccaagcattgcaaggcgtgcagtgcgtgtacttcttccttttgctacaatgcacctgtgtgaaacggggttttcatattacgctgcaacaaaaacaaaatataggaaaagacttgatgctgcacctcatatgcgaatccgacttagcaatattacacctaatattaagcggatatgtgataaaaagacacaaaaacactgttctcattaaaattggaggagtttgcatgtctcatgataaccaaatgtaagatgaaaataaaagatgatttacttcatctctggtatttgggggatttaaataaaatgattccatttttttatactatttagattttaagaaggctaaagaatcaaacgttttaaacat

SEQ ID NO: 419869 - DNA, 1156 bp, Homo sapiens
gggacgctgcggtgccgctttccctatccagtcctgttcccgcggctccccagcctaccccgggccgaccaagaggtccggcggggtctgcgccgcatcagcgcccgctcgtcaggcctagccctccgcacagccaaggccgaccagacctctagacactccgtcgtcgggtgtggggcggagaagtaaagggcgagttttcttcctagattccagtgggaaccaagaaaaggagttggcagctgtgtaaactggacctggggtgcggcctccgggaacaaaagaggtgataaatgcacagcagccgaggttctgcgtgctcctttggggccactacgaatccccgtgaatcaccccagcccgggcagagggccagaaatgatgaaaatgcagattcatggcttccactccagccctacaagatcaccaaccgtatctggcagtacccaggaatctgcattctcgacaagcgtccgcgccgacggggctagtgaagtttgagaacaattgcttcctacccagccgctccgctatcacctaggtagcacggccgctgcggctgaggctgtgactgcggctgcggctgggccgcgcctcaaccgagcttggtcctttcctttggtcccgccccgctgctcagcgcggattggtggcgggacgcaaatctggcgctgattgggcggcggcagagtcgctcgtgaagattgtagggttcgggtgctctagagtgctaaatttatcttcagaccggcgaccgcgccagccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaagagtgcatttcaagctgccaaggtggagagagggattacagaaaggagaacaccttatttcaggtatcttatcctctaccccttaataggagaaccattttgactcaagatctaacatgagaatacaaaacttactctatagccaggttataaagtttaaatcaaaagtagctatatttggacagacataatttgtatgccttgatttatagagttaatag

SEQ ID NO: 419870 - DNA, 363 bp, Homo sapiens
ctgcttagatccagaaagaataaacccatcttacgggtttatagttagttctgcttgttactgtatctaattttaatttttctcattctaggcttttggttactccccttcccaccccatcccttaattttattcttttgaagagtgcatttcaagctgccaaggtggagagagggattacagaaaggagaacaccttatttcaggtatcttatcctctaccccttaataggagaaccattttgactcaagatctaacatgagaatacaaaacttactctatagccaggttataaagtttaaatcaaaagtagctatatttggacagacataatttgtatgccttgatttatagagttaatag

SEQ ID NO: 419871 - DNA, 4775 bp, Homo sapiens
gggacgctgcggtgccgctttccctatccagtcctgttcccgcggctccccagcctaccccgggccgaccaagaggtccggcggggtctgcgccgcatcagcgcccgctcgtcaggcctagccctccgcacagccaaggccgaccagacctctagacactccgtcgtcgggtgtggggcggagaagtaaagggcgagttttcttcctagattccagtgggaaccaagaaaaggagttggcagctgtgtaaactggacctggggtgcggcctccgggaacaaaagaggtgataaatgcacagcagccgaggttctgcgtgctcctttggggccactacgaatccccgtgaatcaccccagcccgggcagagggccagaaatgatgaaaatgcagattcatggcttccactccagccctacaagatcaccaaccgtatctggcagtacccaggaatctgcattctcgacaagcgtccgcgccgacggggctagtgaagtttgagaacaattgcttcctacccagccgctccgctatcacctaggtagcacggccgctgcggctgaggctgtgactgcggctgcggctgggccgcgcctcaaccgagcttggtcctttcctttggtcccgccccgctgctcagcgcggattggtggcgggacgcaaatctggcgctgattgggcggcggcagagtcgctcgtgaagattgtagggttcgggtgctctagagtgctaaatttatcttcagaccggcgaccgcgccagccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaaggtgagaagcagagccgccgccgcggctaagcggtgcgctctgaaatggccgcttcctggaactgcctaagatggcggtcgcgggctctgctgtggaccgcggcgctgctgtgcagcccagccgcggcaaaatccgttctctccatcgctgatggagatgaaatagagagatggtgttgggtgctgagacgttttcatgtggtcgttagcgcaggcggccgcccggggacgcgagagaagacctgaggcgagggtgggctgcgactggtagggagccccccagtcgtggcaatctgtgggcagcgcgcacctgtgacagggaggagctgagggatagttggccctggctgcacatccaggtgaccgtttaaaaaagcatttaggtgttggaaggagcatctgttcccacctttttggctggcctgcactcagatcctgtcctcctgaccctgagggtattgttcccagccggaaccgcccgaagataggggagaaaggattgtgatacttgtcagtttaaccggaaggagactaaagacggaagttttccccgctcttcagggagtggaaaggaaactttactctcaaaggagtccagattctttgtcctcgagaaattcggggaaacaccttcgaagaggcttttggttactccccttcccaccccatcccttaattttattcttttgaagagtgcatttcaagctgccaaggtggagagagggattacagaaaggagaacaccttatttcaggtcctggttaagtcgtcacctgttgtataaatagaatgcagagttatctgtaaaaatatacattactttcattgagtcttaatttggataatataaacgtttatataatttaagtccagagaaacagtacctaacttttgatatacaatttattcttcattgttaacgcataacatttaggatacagtagaattatgtatctcgcaaaacttggaactgtgtgtgtgtttaattcacttcttcagaattgttgctagccctgaagggacttcagatatataatagtatcaacaactaatacatctaatgacagtaggcatcaaaagctaaaagagatttcacaatactacataccatgagacagggctgataaattatggcccatgctgtctggttttgtacgtaaagttttattggaacacacctgtgtccattctttcatgtattgtctatggctgctgtcatgttacaactacagagttgagtagttgcaacagagactatatggcccttgaccaaaaaaagcctgccaacccctgccatgggacatattcttcagggtccctttcttaaaaatatgtataacaactcttaataatttattggctcagtgattcccaaattatgttttatagaatattaatattctctaagttaataaatgttttgagaaaatgattgatgctaatattggtttttctttatggttgattttaatatgtttatttaaatatgagattaagactgctaaactcatttctatagcttttatttttatgtgataatctacctttaagaaaaggtgtaccatacctgagagcaccaggaagtcgcatgagagatcacctgatacatgaacgtatgatgttccatctgcgcattgatgaataggcagcatttacaaattaactgatgtgttgctgtatatcatctctttgatgattgctcctcttctttgtatcctgtcttataatttcaacacatttgcgatactcaatgtctattctaaattaaccatgttttgtaccacaaactcattgcccatggatctgttgctgaaacaaggaagtcttaaacaagaagtggaatctttctgttatcagattgtgtctgaatcaaatgatcagaaggttggaatattacaaagtgaagataagcagttgcaaccttcagtttctaaaaaatcagaaggtgagctttccagggtcaaatttatatccaattccaacaaaataacatttagtaaaaaaccaaaaagaagaaaatatgatgaaagttatttgtcttttggatttacttacttcggaaatagagatgcacctcatgctcagtgtgtattatgtaagaaaattttatcaaatagctctttagcccctagtaagcttcgaagacatttggaaactaaacatgctgcatataaagacaaagacataagctttttcaagcaacatctcgattcacctgaaaataataaacccccaacacctaaaattgtgaatacagataatgaaagtgctacagaagcatcatacaatgtaagttaccatatagcgctgagtggagaggctcatactattggagaattgcttatcaaaccttgtgcaaaagatgtagtgatgcggatgtttgatgaacaatatagtaaaaaaatagatgcagtacagctatcaaacagtactgttgcacgtcgaattaaggatctagctgctgacattgaagaagagcttgtttgtagactgaaaatttgcgatgggttttcactgcaactagatgaatcagctgatgtttcaggacttgctgtgctgcttgtgtttgttcgttataggtttaataagtctattgaggaagacctactcctgtgtgaatctttgcaaagtaatgctaccggtgaagaaatattcaactgtatcaacagttttatgcagaaacatgaaattgaatgggaaaaatgtgttgatgtttgtagtgatgcttctagggcagtggatgggaaaattgccgaagctgtcaccttaataaaatatgtggctcccgaaagcaccagtagtcactgcctattatacagacatgcactggcagttaaaataatgcctacatctctaaaaaatgtgctagaccaggcagtacaaatcatcaattatattaaagctcgaccacatcaatccagactattaaaaattttatgtgaggaaatgggtgctcagcacacagcacttcttctaaatacagaggtgaggtggctttctcgaggtaaagttcttgtaagactttttgaacttcgtcgtgaacttttggttttcatggattctgcttttcgactatctgattgtttaacaaattcatcttggctgctaagacttgcatatcttgcagatatttttactaaattaaatgaagttaatttgtcaatgcaaggaaaaaatgtgaccgtttttacagtatttgataaaatgtcgtcattgttaagaaaattggaattttgggcctcatctgtagaagaagaaaactttgattgttttcctacactcagtgattttttgactgaaattaattctacagttgataaagatatttgcagtgccattgtgcagcacctaaggggtttgcgcgctactctgttaaaatactttcctgtaacaaatgacaataatgcttgggttagaaatccatttacagttactgttaaaccagcttcattagtagcacgggactatgagagcctgattgatttaacatctgattctcaagtgaagcaaaattttagtgaactttcactaaatgatttttggagtagcctaattcaggaatacccaagcattgcaaggcgtgcagtgcgtgtacttcttccttttgctacaatgcacctgtgtgaaacggggttttcatattacgctgcaacaaaaacaaaatataggaaaagacttgatgctgcacctcatatgcgaatccgacttagcaatattacacctaatattaagcggatatgtgataaaaagacacaaaaacactgttctcattaaaattggaggagtttgcatgtctcatgataaccaaatgtaagatgaaaataaaagatgatttacttc

SEQ ID NO: 419872 - DNA, 4868 bp, Homo sapiens
gggacgctgcggtgccgctttccctatccagtcctgttcccgcggctccccagcctaccccgggccgaccaagaggtccggcggggtctgcgccgcatcagcgcccgctcgtcaggcctagccctccgcacagccaaggccgaccagacctctagacactccgtcgtcgggtgtggggcggagaagtaaagggcgagttttcttcctagattccagtgggaaccaagaaaaggagttggcagctgtgtaaactggacctggggtgcggcctccgggaacaaaagaggtgataaatgcacagcagccgaggttctgcgtgctcctttggggccactacgaatccccgtgaatcaccccagcccgggcagagggccagaaatgatgaaaatgcagattcatggcttccactccagccctacaagatcaccaaccgtatctggcagtacccaggaatctgcattctcgacaagcgtccgcgccgacggggctagtgaagtttgagaacaattgcttcctacccagccgctccgctatcacctaggtagcacggccgctgcggctgaggctgtgactgcggctgcggctgggccgcgcctcaaccgagcttggtcctttcctttggtcccgccccgctgctcagcgcggattggtggcgggacgcaaatctggcgctgattgggcggcggcagagtcgctcgtgaagattgtagggttcgggtgctctagagtgctaaatttatcttcagaccggcgaccgcgccagccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaaggtgagaagcagagccgccgccgcggctaagcggtgcgctctgaaatggccgcttcctggaactgcctaagatggcggtcgcgggctctgctgtggaccgcggcgctgctgtgcagcccagccgcggcaaaatccgttctctccatcgctgatggagatgaaatagagagatggtgttgggtgctgagacgttttcatgtggtcgttagcgcaggcggccgcccggggacgcgagagaagacctgaggcgagggtgggctgcgactggtagggagccccccagtcgtggcaatctgtgggcagcgcgcacctgtgacagggaggagctgagggatagttggccctggctgcacatccaggtgaccgtttaaaaaagcatttaggtgttggaaggagcatctgttcccacctttttggctggcctgcactcagatcctgtcctcctgaccctgagggtattgttcccagccggaaccgcccgaagataggggagaaaggattgtgatacttgtcagtttaaccggaaggagactaaagacggaagttttccccgctcttcagggagtggaaaggaaactttactctcaaaggagtccagattctttgtcctcgagaaattcggggaaacaccttcgaagaggcttttggttactccccttcccaccccatcccttaattttattcttttgaagagtgcatttcaagctgccaaggtggagagagggattacagaaaggagaacaccttatttcaggtcctggttaagtcgtcacctgttgtataaatagaatgcagagttatctgtaaaaatatacattactttcattgagtcttaatttggataatataaacgtttatataatttaagtccagagaaacagtacctaacttttgatatacaatttattcttcattgttaacgcataacatttaggatacagtagaattatgtatctcgcaaaacttggaactgtgtgtgtgtttaattcacttcttcagaattgttgctagccctgaagggacttcagatatataatagtatcaacaactaatacatctaatgacagtaggcatcaaaagctaaaagagatttcacaatactacataccatgagacagggctgataaattatggcccatgctgtctggttttgtacgtaaagttttattggaacacacctgtgtccattctttcatgtattgtctatggctgctgtcatgttacaactacagagttgagtagttgcaacagagactatatggcccttgaccaaaaaaagcctgccaacccctgccatgggacatattcttcagggtccctttcttaaaaatatgtataacaactcttaataatttattggctcagtgattcccaaattatgttttatagaatattaatattctctaagttaataaatgttttgagaaaatgattgatgctaatattggtttttctttatggttgattttaatatgtttatttaaatatgagattaagactgctaaactcatttctatagcttttatttttatgtgataatctacctttaagaaaaggtgtaccatacctgagagcaccaggaagtcgcatgagagatcacctgatacatgaacgtatgatgttccatctgcgcattgatgaataggcagcatttacaaattaactgatgtgttgctgtatatcatctctttgatgattgctcctcttctttgtatcctgtcttataatttcaacacatttgcgatactcaatgtctattctaaattaaccatgttttgtaccacaaactcattgcccatggatctgttgctgaaacaaggaagtcttaaacaagaagtggaatctttctgttatcagattgtgtctgaatcaaatgatcagaaggttggaatattacaaagtgaagataagcagttgcaaccttcagtttctaaaaaatcagaaggtgagctttccagggtcaaatttatatccaattccaacaaaataacatttagtaaaaaaccaaaaagaagaaaatatgatgaaagttatttgtcttttggatttacttacttcggaaatagagatgcacctcatgctcagtgtgtattatgtaagaaaattttatcaaatagctctttagcccctagtaagcttcgaagacatttggaaactaaacatgctgcatataaagacaaagacataagctttttcaagcaacatctcgattcacctgaaaataataaacccccaacacctaaaattgtgaatacagataatgaaagtgctacagaagcatcatacaatgtaagttaccatatagcgctgagtggagaggctcatactattggagaattgcttatcaaaccttgtgcaaaagatgtagtgatgcggatgtttgatgaacaatatagtaaaaaaatagatgcagtacagctatcaaacagtactgttgcacgtcgaattaaggatctagctgctgacattgaagaagagcttgtttgtagactgaaaatttgcgatgggttttcactgcaactagatgaatcagctgatgtttcaggacttgctgtgctgcttgtgtttgttcgttataggtttaataagtctattgaggaagacctactcctgtgtgaatctttgcaaagtaatgctaccggtgaagaaatattcaactgtatcaacagttttatgcagaaacatgaaattgaatgggaaaaatgtgttgatgtttgtagtgatgcttctagggcagtggatgggaaaattgccgaagctgtcaccttaataaaatatgtggctcccgaaagcaccagtagtcactgcctattatacagacatgcactggcagttaaaataatgcctacatctctaaaaaatgtgctagaccaggcagtacaaatcatcaattatattaaagctcgaccacatcaatccagactattaaaaattttatgtgaggaaatgggtgctcagcacacagcacttcttctaaatacagaggtgaggtggctttctcgaggtaaagttcttgtaagactttttgaacttcgtcgtgaacttttggttttcatggattctgcttttcgactatctgattgtttaacaaattcatcttggctgctaagacttgcatatcttgcagatatttttactaaattaaatgaagttaatttgtcaatgcaaggaaaaaatgtgaccgtttttacagtatttgataaaatgtcgtcattgttaagaaaattggaattttgggcctcatctgtagaagaagaaaactttgattgttttcctacactcagtgattttttgactgaaattaattctacagttgataaagatatttgcagtgccattgtgcagcacctaaggggtttgcgcgctactctgttaaaatactttcctgtaacaaatgacaataatgcttgggttagaaatccatttacagttactgttaaaccagcttcattagtagcacgggactatgagagcctgattgatttaacatctgattctcaagtgaagcaaaattttagtgaactttcactaaatgatttttggagtagcctaattcaggaatacccaagcattgcaaggcgtgcagtgcgtgtacttcttccttttgctacaatgcacctgtgtgaaacggggttttcatattacgctgcaacaaaaacaaaatataggaaaagacttgatgctgcacctcatatgcgaatccgacttagcaatattacacctaatattaagcggatatgtgataaaaagacacaaaaacactgttctcattaaaattggaggagtttgcatgtctcatgataaccaaatgtaagatgaaaataaaagatgatttacttcatctctggtatttgggggatttaaataaaatgattccatttttttatactatttagattttaagaaggctaaagaatcaaacgttttaaacat

SEQ ID NO: 419873 - DNA, 3433 bp, Homo sapiens
gggacgctgcggtgccgctttccctatccagtcctgttcccgcggctccccagcctaccccgggccgaccaagaggtccggcggggtctgcgccgcatcagcgcccgctcgtcaggcctagccctccgcacagccaaggccgaccagacctctagacactccgtcgtcgggtgtggggcggagaagtaaagggcgagttttcttcctagattccagtgggaaccaagaaaaggagttggcagctgtgtaaactggacctggggtgcggcctccgggaacaaaagaggtgataaatgcacagcagccgaggttctgcgtgctcctttggggccactacgaatccccgtgaatcaccccagcccgggcagagggccagaaatgatgaaaatgcagattcatggcttccactccagccctacaagatcaccaaccgtatctggcagtacccaggaatctgcattctcgacaagcgtccgcgccgacggggctagtgaagtttgagaacaattgcttcctacccagccgctccgctatcacctaggtagcacggccgctgcggctgaggctgtgactgcggctgcggctgggccgcgcctcaaccgagcttggtcctttcctttggtcccgccccgctgctcagcgcggattggtggcgggacgcaaatctggcgctgattgggcggcggcagagtcgctcgtgaagattgtagggttcgggtgctctagagtgctaaatttatcttcagaccggcgaccgcgccagccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaaggcttttggttactccccttcccaccccatcccttaattttattcttttgaagagtgcatttcaagctgccaaggtggagagagggattacagaaaggagaacaccttatttcagaaaaggtgtaccatacctgagagcaccaggaagtcgcatgagagatcacctgatacatgaacgtatgatgttccatctgcgcattgatgaataggcagcatttacaaattaactgatgtgttgctgtatatcatctctttgatgattgctcctcttctttgtatcctgtcttataatttcaacacatttgcgatactcaatgtctattctaaattaaccatgttttgtaccacaaactcattgcccatggatctgttgctgaaacaaggaagtcttaaacaagaagtggaatctttctgttatcagattgtgtctgaatcaaatgatcagaaggttggaatattacaaagtgaagataagcagttgcaaccttcagtttctaaaaaatcagaaggtgagctttccagggtcaaatttatatccaattccaacaaaataacatttagtaaaaaaccaaaaagaagaaaatatgatgaaagttatttgtcttttggatttacttacttcggaaatagagatgcacctcatgctcagtgtgtattatgtaagaaaattttatcaaatagctctttagcccctagtaagcttcgaagacatttggaaactaaacatgctgcatataaagacaaagacataagctttttcaagcaacatctcgattcacctgaaaataataaacccccaacacctaaaattgtgaatacagataatgaaagtgctacagaagcatcatacaatgtaagttaccatatagcgctgagtggagaggctcatactattggagaattgcttatcaaaccttgtgcaaaagatgtagtgatgcggatgtttgatgaacaatatagtaaaaaaatagtgggggggtggggttggggggtggggtagagagggtgtggggggtgggggagctgctgacattgaagaagagcttgtttgtagactgaaaatttgcgatgggttttcactgcaactagatgaatcagctgatgtttcaggacttgctgtgctgcttgtgtttgttcgttataggtttaataagtctattgaggaagacctactcctgtgtgaatctttgcaaagtaatgctaccggtgaagaaatattcaactgtatcaacagttttatgcagaaacatgaaattgaatgggaaaaatgtgttgatgtttgtagtgatgcttctagggcagtggatgggaaaattgccgaagctgtcaccttaataaaatatgtggctcccgaaagcaccagtagtcactgcctattatacagacatgcactggcagttaaaataatgcctacatctctaaaaaatgtgctagaccaggcagtacaaatcatcaattatattaaagctcgaccacatcaatccagactattaaaaattttatgtgaggaaatgggtgctcagcacacagcacttcttctaaatacagaggtgaggtggctttctcgaggtaaagttcttgtaagactttttgaacttcgtcgtgaacttttggttttcatggattctgcttttcgactatctgattgtttaacaaattcatcttggctgctaagacttgcatatcttgcagatatttttactaaattaaatgaagttaatttgtcaatgcaaggaaaaaatgtgaccgtttttacagtatttgataaaatgtcgtcattgttaagaaaattggaattttgggcctcatctgtagaagaagaaaactttgattgttttcctacactcagtgattttttgactgaaattaattctacagttgataaagatatttgcagtgccattgtgcagcacctaaggggtttgcgcgctactctgttaaaatactttcctgtaacaaatgacaataatgcttgggttagaaatccatttacagttactgttaaaccagcttcattagtagcacgggactatgagagcctgattgatttaacatctgattctcaagtgaagcaaaattttagtgaactttcactaaatgatttttggagtagcctaattcaggaatacccaagcattgcaaggcgtgcagtgcgtgtacttcttccttttgctacaatgcacctgtgtgaaacggggttttcatattacgctgcaacaaaaacaaaatataggaaaagacttgatgctgcacctcatatgcgaatccgacttagcaatattacacctaatattaagcggatatgtgataaaaagacacaaaaacactgttctcattaaaattggaggagtttgcatgtctcatgataaccaaatgtaagatgaaaataaaagatgatttacttcatctctggtatttgggggatttaaataaaatgattccatttttttatactatttagattttaagaaggctaaagaatcaaacgttttaaacat

SEQ ID NO: 419874 - DNA, 1927 bp, Homo sapiens
gggacgctgcggtgccgctttccctatccagtcctgttcccgcggctccccagcctaccccgggccgaccaagaggtccggcggggtctgcgccgcatcagcgcccgctcgtcaggcctagccctccgcacagccaaggccgaccagacctctagacactccgtcgtcgggtgtggggcggagaagtaaagggcgagttttcttcctagattccagtgggaaccaagaaaaggagttggcagctgtgtaaactggacctggggtgcggcctccgggaacaaaagaggtgataaatgcacagcagccgaggttctgcgtgctcctttggggccactacgaatccccgtgaatcaccccagcccgggcagagggccagaaatgatgaaaatgcagattcatggcttccactccagccctacaagatcaccaaccgtatctggcagtacccaggaatctgcattctcgacaagcgtccgcgccgacggggctagtgaagtttgagaacaattgcttcctacccagccgctccgctatcacctaggtagcacggccgctgcggctgaggctgtgactgcggctgcggctgggccgcgcctcaaccgagcttggtcctttcctttggtcccgccccgctgctcagcgcggattggtggcgggacgcaaatctggcgctgattgggcggcggcagagtcgctcgtgaagattgtagggttcgggtgctctagagtgctaaatttatcttcagaccggcgaccgcgccagccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaaggtgagaagcagagccgccgccgcggctaagcggtgcgctctgaaatggccgcttcctggaactgcctaagatggcggtcgcgggctctgctgtggaccgcggcgctgctgtgcagcccagccgcggcaaaatccgttctctccatcgctgatggagatgaaatagagagatggtgttgggtgctgagacgttttcatgtggtcgttagcgcaggcggccgcccggggacgcgagagaagacctgaggcgagggtgggctgcgactggtagggagccccccagtcgtggcaatctgtgggcagcgcgcacctgtgacagggaggagctgagggatagttggccctggctgcacatccaggtgaccgtttaaaaaagcatttaggtgttggaaggagcatctgttcccacctttttggctggcctgcactcagatcctgtcctcctgaccctgagggtattgttcccagccggaaccgcccgaagataggggagaaaggattgtgatacttgtcagtttaaccggaaggagactaaagacggaagttttccccgctcttcagggagtggaaaggaaactttactctcaaaggagtccagattctttgtcctcgagaaattcggggaaacaccttcgaagaggtggggttgaggaccttctttctgaaaacaaaagcttcctactcttctgtgtcctctggcaacgagagggatcctgatcttttacgtgaaccagcagctccacagagttctccgttgcaaaatccaaaaggagactgtggaaggagaatctgcttttttgctcccaataagaagcagggctttatgctgttgctagtatgagaccctcgactttctggcagttataatccattgttcatccgtttcgctgcataacccaactcctagtaacgagattttttagtagttggggaattaaaagtattcaggaacacccaagtaatggctagacacatgggctatgcagtcaaac

SEQ ID NO: 419875 - DNA, 3339 bp, Homo sapiens
gggacgctgcggtgccgctttccctatccagtcctgttcccgcggctccccagcctaccccgggccgaccaagaggtccggcggggtctgcgccgcatcagcgcccgctcgtcaggcctagccctccgcacagccaaggccgaccagacctctagacactccgtcgtcgggtgtggggcggagaagtaaagggcgagttttcttcctagattccagtgggaaccaagaaaaggagttggcagctgtgtaaactggacctggggtgcggcctccgggaacaaaagaggtgataaatgcacagcagccgaggttctgcgtgctcctttggggccactacgaatccccgtgaatcaccccagcccgggcagagggccagaaatgatgaaaatgcagattcatggcttccactccagccctacaagatcaccaaccgtatctggcagtacccaggaatctgcattctcgacaagcgtccgcgccgacggggctagtgaagtttgagaacaattgcttcctacccagccgctccgctatcacctaggtagcacggccgctgcggctgaggctgtgactgcggctgcggctgggccgcgcctcaaccgagcttggtcctttcctttggtcccgccccgctgctcagcgcggattggtggcgggacgcaaatctggcgctgattgggcggcggcagagtcgctcgtgaagattgtagggttcgggtgctctagagtgctaaatttatcttcagaccggcgaccgcgccagccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaaggcttttggttactccccttcccaccccatcccttaattttattcttttgaagagtgcatttcaagctgccaaggtggagagagggattacagaaaggagaacaccttatttcagaaaaggtgtaccatacctgagagcaccaggaagtcgcatgagagatcacctgatacatgaacgtatgatgttccatctgcgcattgatgaataggcagcatttacaaattaactgatgtgttgctgtatatcatctctttgatgattgctcctcttctttgtatcctgtcttataatttcaacacatttgcgatactcaatgtctattctaaattaaccatgttttgtaccacaaactcattgcccatggatctgttgctgaaacaaggaagtcttaaacaagaagtggaatctttctgttatcagattgtgtctgaatcaaatgatcagaaggttggaatattacaaagtgaagataagcagttgcaaccttcagtttctaaaaaatcagaaggtgagctttccagggtcaaatttatatccaattccaacaaaataacatttagtaaaaaaccaaaaagaagaaaatatgatgaaagttatttgtcttttggatttacttacttcggaaatagagatgcacctcatgctcagtgtgtattatgtaagaaaattttatcaaatagctctttagcccctagtaagcttcgaagacatttggaaactaaacatgctgcatataaagacaaagacataagctttttcaagcaacatctcgattcacctgaaaataataaacccccaacacctaaaattgtgaatacagataatgaaagtgctacagaagcatcatacaatgtaagttaccatatagcgctgagtggagaggctcatactattggagaattgcttatcaaaccttgtgcaaaagatgtagtgatgcggatgtttgatgaacaatatagtaaaaaaatagatgcagtacagctatcaaacagtactgttgcacgtcgaattaaggatctagctgctgacattgaagaagagcttgtttgtagactgaaaatttgcgatgggttttcactgcaactagatgaatcagctgatgtttcaggacttgctgtgctgcttgtgtttgttcgttataggtttaataagtctattgaggaagacctactcctgtgtgaatctttgcaaagtaatgctaccggtgaagaaatattcaactgtatcaacagttttatgcagaaacatgaaattgaatgggaaaaatgtgttgatgtttgtagtgatgcttctagggcagtggatgggaaaattgccgaagctgtcaccttaataaaatatgtggctcccgaaagcaccagtagtcactgcctattatacagacatgcactggcagttaaaataatgcctacatctctaaaaaatgtgctagaccaggcagtacaaatcatcaattatattaaagctcgaccacatcaatccagactattaaaaattttatgtgaggaaatgggtgctcagcacacagcacttcttctaaatacagaggtgaggtggctttctcgaggtaaagttcttgtaagactttttgaacttcgtcgtgaacttttggttttcatggattctgcttttcgactatctgattgtttaacaaattcatcttggctgctaagacttgcatatcttgcagatatttttactaaattaaatgaagttaatttgtcaatgcaaggaaaaaatgtgaccgtttttacagtatttgataaaatgtcgtcattgttaagaaaattggaattttgggcctcatctgtagaagaagaaaactttgattgttttcctacactcagtgattttttgactgaaattaattctacagttgataaagatatttgcagtgccattgtgcagcacctaaggggtttgcgcgctactctgttaaaatactttcctgtaacaaatgacaataatgcttgggttagaaatccatttacagttactgttaaaccagcttcattagtagcacgggactatgagagcctgattgatttaacatctgattctcaagtgaagcaaaattttagtgaactttcactaaatgatttttggagtagcctaattcaggaatacccaagcattgcaaggcgtgcagtgcgtgtacttcttccttttgctacaatgcacctgtgtgaaacggggttttcatattacgctgcaacaaaaacaaaatataggaaaagacttgatgctgcacctcatatgcgaatccgacttagcaatattacacctaatattaagcggatatgtgataaaaagacacaaaaacactgttctcattaaaattggaggagtttgcatgtctcatgataaccaaatgtaagatgaaaataaaagatgatttacttc

SEQ ID NO: 419876 - DNA, 4136 bp, Homo sapiens
gggacgctgcggtgccgctttccctatccagtcctgttcccgcggctccccagcctaccccgggccgaccaagaggtccggcggggtctgcgccgcatcagcgcccgctcgtcaggcctagccctccgcacagccaaggccgaccagacctctagacactccgtcgtcgggtgtggggcggagaagtaaagggcgagttttcttcctagattccagtgggaaccaagaaaaggagttggcagctgtgtaaactggacctggggtgcggcctccgggaacaaaagaggtgataaatgcacagcagccgaggttctgcgtgctcctttggggccactacgaatccccgtgaatcaccccagcccgggcagagggccagaaatgatgaaaatgcagattcatggcttccactccagccctacaagatcaccaaccgtatctggcagtacccaggaatctgcattctcgacaagcgtccgcgccgacggggctagtgaagtttgagaacaattgcttcctacccagccgctccgctatcacctaggtagcacggccgctgcggctgaggctgtgactgcggctgcggctgggccgcgcctcaaccgagcttggtcctttcctttggtcccgccccgctgctcagcgcggattggtggcgggacgcaaatctggcgctgattgggcggcggcagagtcgctcgtgaagattgtagggttcgggtgctctagagtgctaaatttatcttcagaccggcgaccgcgccagccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaaggcttttggttactccccttcccaccccatcccttaattttattcttttgaagagtgcatttcaagctgccaaggtggagagagggattacagaaaggagaacaccttatttcaggtcctggttaagtcgtcacctgttgtataaatagaatgcagagttatctgtaaaaatatacattactttcattgagtcttaatttggataatataaacgtttatataatttaagtccagagaaacagtacctaacttttgatatacaatttattcttcattgttaacgcataacatttaggatacagtagaattatgtatctcgcaaaacttggaactgtgtgtgtgtttaattcacttcttcagaattgttgctagccctgaagggacttcagatatataatagtatcaacaactaatacatctaatgacagtaggcatcaaaagctaaaagagatttcacaatactacataccatgagacagggctgataaattatggcccatgctgtctggttttgtacgtaaagttttattggaacacacctgtgtccattctttcatgtattgtctatggctgctgtcatgttacaactacagagttgagtagttgcaacagagactatatggcccttgaccaaaaaaagcctgccaacccctgccatgggacatattcttcagggtccctttcttaaaaatatgtataacaactcttaataatttattggctcagtgattcccaaattatgttttatagaatattaatattctctaagttaataaatgttttgagaaaatgattgatgctaatattggtttttctttatggttgattttaatatgtttatttaaatatgagattaagactgctaaactcatttctatagcttttatttttatgtgataatctacctttaagaaaaggtgtaccatacctgagagcaccaggaagtcgcatgagagatcacctgatacatgaacgtatgatgttccatctgcgcattgatgaataggcagcatttacaaattaactgatgtgttgctgtatatcatctctttgatgattgctcctcttctttgtatcctgtcttataatttcaacacatttgcgatactcaatgtctattctaaattaaccatgttttgtaccacaaactcattgcccatggatctgttgctgaaacaaggaagtcttaaacaagaagtggaatctttctgttatcagattgtgtctgaatcaaatgatcagaaggttggaatattacaaagtgaagataagcagttgcaaccttcagtttctaaaaaatcagaaggtgagctttccagggtcaaatttatatccaattccaacaaaataacatttagtaaaaaaccaaaaagaagaaaatatgatgaaagttatttgtcttttggatttacttacttcggaaatagagatgcacctcatgctcagtgtgtattatgtaagaaaattttatcaaatagctctttagcccctagtaagcttcgaagacatttggaaactaaacatgctgcatataaagacaaagacataagctttttcaagcaacatctcgattcacctgaaaataataaacccccaacacctaaaattgtgaatacagataatgaaagtgctacagaagcatcatacaatgtaagttaccatatagcgctgagtggagaggctcatactattggagaattgcttatcaaaccttgtgcaaaagatgtagtgatgcggatgtttgatgaacaatatagtaaaaaaatagatgcagtacagctatcaaacagtactgttgcacgtcgaattaaggatctagctgctgacattgaagaagagcttgtttgtagactgaaaatttgcgatgggttttcactgcaactagatgaatcagctgatgtttcaggacttgctgtgctgcttgtgtttgttcgttataggtttaataagtctattgaggaagacctactcctgtgtgaatctttgcaaagtaatgctaccggtgaagaaatattcaactgtatcaacagttttatgcagaaacatgaaattgaatgggaaaaatgtgttgatgtttgtagtgatgcttctagggcagtggatgggaaaattgccgaagctgtcaccttaataaaatatgtggctcccgaaagcaccagtagtcactgcctattatacagacatgcactggcagttaaaataatgcctacatctctaaaaaatgtgctagaccaggcagtacaaatcatcaattatattaaagctcgaccacatcaatccagactattaaaaattttatgtgaggaaatgggtgctcagcacacagcacttcttctaaatacagaggtgaggtggctttctcgaggtaaagttcttgtaagactttttgaacttcgtcgtgaacttttggttttcatggattctgcttttcgactatctgattgtttaacaaattcatcttggctgctaagacttgcatatcttgcagatatttttactaaattaaatgaagttaatttgtcaatgcaaggaaaaaatgtgaccgtttttacagtatttgataaaatgtcgtcattgttaagaaaattggaattttgggcctcatctgtagaagaagaaaactttgattgttttcctacactcagtgattttttgactgaaattaattctacagttgataaagatatttgcagtgccattgtgcagcacctaaggggtttgcgcgctactctgttaaaatactttcctgtaacaaatgacaataatgcttgggttagaaatccatttacagttactgttaaaccagcttcattagtagcacgggactatgagagcctgattgatttaacatctgattctcaagtgaagcaaaattttagtgaactttcactaaatgatttttggagtagcctaattcaggaatacccaagcattgcaaggcgtgcagtgcgtgtacttcttccttttgctacaatgcacctgtgtgaaacggggttttcatattacgctgcaacaaaaacaaaatataggaaaagacttgatgctgcacctcatatgcgaatccgacttagcaatattacacctaatattaagcggatatgtgataaaaagacacaaaaacactgttctcattaaaattggaggagtttgcatgtctcatgataaccaaatgtaagatgaaaataaaagatgatttacttc

SEQ ID NO: 419877 - DNA, 4720 bp, Homo sapiens
gggacgctgcggtgccgctttccctatccagtcctgttcccgcggctccccagcctaccccgggccgaccaagaggtccggcggggtctgcgccgcatcagcgcccgctcgtcaggcctagccctccgcacagccaaggccgaccagacctctagacactccgtcgtcgggtgtggggcggagaagtaaagggcgagttttcttcctagattccagtgggaaccaagaaaaggagttggcagctgtgtaaactggacctggggtgcggcctccgggaacaaaagaggtgataaatgcacagcagccgaggttctgcgtgctcctttggggccactacgaatccccgtgaatcaccccagcccgggcagagggccagaaatgatgaaaatgcagattcatggcttccactccagccctacaagatcaccaaccgtatctggcagtacccaggaatctgcattctcgacaagcgtccgcgccgacggggctagtgaagtttgagaacaattgcttcctacccagccgctccgctatcacctaggtagcacggccgctgcggctgaggctgtgactgcggctgcggctgggccgcgcctcaaccgagcttggtcctttcctttggtcccgccccgctgctcagcgcggattggtggcgggacgcaaatctggcgctgattgggcggcggcagagtcgctcgtgaagattgtagggttcgggtgctctagagtgctaaatttatcttcagaccggcgaccgcgccagccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaaggtgagaagcagagccgccgccgcggctaagcggtgcgctctgaaatggccgcttcctggaactgcctaagatggcggtcgcgggctctgctgtggaccgcggcgctgctgtgcagcccagccgcggcaaaatccgttctctccatcgctgatggagatgaaatagagagatggtgttgggtgctgagacgttttcatgtggtcgttagcgcaggcggccgcccggggacgcgagagaagacctgaggcgagggtgggctgcgactggtagggagccccccagtcgtggcaatctgtgggcagcgcgcacctgtgacagggaggagctgagggatagttggccctggctgcacatccaggtgaccgtttaaaaaagcatttaggtgttggaaggagcatctgttcccacctttttggctggcctgcactcagatcctgtcctcctgaccctgagggtattgttcccagccggaaccgcccgaagataggggagaaaggattgtgatacttgtcagtttaaccggaaggagactaaagacggaagttttccccgctcttcagggagtggaaaggaaactttactctcaaaggagtccagattctttgtcctcgagaaattcggggaaacaccttcgaagaggcttttggttactccccttcccaccccatcccttaattttattcttttgaagagtgcatttcaagctgccaaggtggagagagggattacagaaaggagaacaccttatttcaggtcctggttaagtcgtcacctgttgtataaatagaatgcagagttatctgtaaaaatatacattactttcattgagtcttaatttggataatataaacgtttatataatttaagtccagagaaacagtacctaacttttgatatacaatttattcttcattgttaacgcataacatttaggatacagtagaattatgtatctcgcaaaacttggaactgtgtgtgtgtttaattcacttcttcagaattgttgctagccctgaagggacttcagatatataatagtatcaacaactaatacatctaatgacagtaggcatcaaaagccatgctgtctggttttgtacgtaaagttttattggaacacacctgtgtccattctttcatgtattgtctatggctgctgtcatgttacaactacagagttgagtagttgcaacagagactatatggcccttgaccaaaaaaagcctgccaacccctgccatgggacatattcttcagggtccctttcttaaaaatatgtataacaactcttaataatttattggctcagtgattcccaaattatgttttatagaatattaatattctctaagttaataaatgttttgagaaaatgattgatgctaatattggtttttctttatggttgattttaatatgtttatttaaatatgagattaagactgctaaactcatttctatagcttttatttttatgtgataatctacctttaagaaaaggtgtaccatacctgagagcaccaggaagtcgcatgagagatcacctgatacatgaacgtatgatgttccatctgcgcattgatgaataggcagcatttacaaattaactgatgtgttgctgtatatcatctctttgatgattgctcctcttctttgtatcctgtcttataatttcaacacatttgcgatactcaatgtctattctaaattaaccatgttttgtaccacaaactcattgcccatggatctgttgctgaaacaaggaagtcttaaacaagaagtggaatctttctgttatcagattgtgtctgaatcaaatgatcagaaggttggaatattacaaagtgaagataagcagttgcaaccttcagtttctaaaaaatcagaaggtgagctttccagggtcaaatttatatccaattccaacaaaataacatttagtaaaaaaccaaaaagaagaaaatatgatgaaagttatttgtcttttggatttacttacttcggaaatagagatgcacctcatgctcagtgtgtattatgtaagaaaattttatcaaatagctctttagcccctagtaagcttcgaagacatttggaaactaaacatgctgcatataaagacaaagacataagctttttcaagcaacatctcgattcacctgaaaataataaacccccaacacctaaaattgtgaatacagataatgaaagtgctacagaagcatcatacaatgtaagttaccatatagcgctgagtggagaggctcatactattggagaattgcttatcaaaccttgtgcaaaagatgtagtgatgcggatgtttgatgaacaatatagtaaaaaaatagatgcagtacagctatcaaacagtactgttgcacgtcgaattaaggatctagctgctgacattgaagaagagcttgtttgtagactgaaaatttgcgatgggttttcactgcaactagatgaatcagctgatgtttcaggacttgctgtgctgcttgtgtttgttcgttataggtttaataagtctattgaggaagacctactcctgtgtgaatctttgcaaagtaatgctaccggtgaagaaatattcaactgtatcaacagttttatgcagaaacatgaaattgaatgggaaaaatgtgttgatgtttgtagtgatgcttctagggcagtggatgggaaaattgccgaagctgtcaccttaataaaatatgtggctcccgaaagcaccagtagtcactgcctattatacagacatgcactggcagttaaaataatgcctacatctctaaaaaatgtgctagaccaggcagtacaaatcatcaattatattaaagctcgaccacatcaatccagactattaaaaattttatgtgaggaaatgggtgctcagcacacagcacttcttctaaatacagaggtgaggtggctttctcgaggtaaagttcttgtaagactttttgaacttcgtcgtgaacttttggttttcatggattctgcttttcgactatctgattgtttaacaaattcatcttggctgctaagacttgcatatcttgcagatatttttactaaattaaatgaagttaatttgtcaatgcaaggaaaaaatgtgaccgtttttacagtatttgataaaatgtcgtcattgttaagaaaattggaattttgggcctcatctgtagaagaagaaaactttgattgttttcctacactcagtgattttttgactgaaattaattctacagttgataaagatatttgcagtgccattgtgcagcacctaaggggtttgcgcgctactctgttaaaatactttcctgtaacaaatgacaataatgcttgggttagaaatccatttacagttactgttaaaccagcttcattagtagcacgggactatgagagcctgattgatttaacatctgattctcaagtgaagcaaaattttagtgaactttcactaaatgatttttggagtagcctaattcaggaatacccaagcattgcaaggcgtgcagtgcgtgtacttcttccttttgctacaatgcacctgtgtgaaacggggttttcatattacgctgcaacaaaaacaaaatataggaaaagacttgatgctgcacctcatatgcgaatccgacttagcaatattacacctaatattaagcggatatgtgataaaaagacacaaaaacactgttctcattaaaattggaggagtttgcatgtctcatgataaccaaatgtaagatgaaaataaaagatgatttacttc

SEQ ID NO: 419878 - DNA, 4266 bp, Homo sapiens
gacgttggcggcagaggcggaggcggacggggtcagcccaaagcagaggctcggccatgaacttacccgggacagcggcggcggcggaccttttggccatcttctcgcagagtgctccctgctaacggggacagattttaacattatggcagggaggcatcagaatcgtagttttcctcttccaggagttcagtcaagtggtcaagtacatgcatttggaaattgttcagacagtgatattttggaggaggatgctgaagtgtatgaacttcgatccagaggaaaagagaaagtccgaagaagtacatcaagagatagacttgacgacattatagtattaacaaaagatatacaagaaggagatacattaaatgcaatagcccttcagtactgttgtacggtagcagatatcaagagagttaacaatctcatcagtgatcaagacttttttgcccttaggtctatcaaaattccagtaaaaaagttcagttccttgaccgaaacactttgtcctccaaaaggaagacagacttcacgtcattcatctgttcaatactcttccgaacaacaggaaattttgccagctaatgattctcttgcttacagtgactcagctggtagctttttaaaagaagtagaccgagacatagaacaaatagtaaagtgtacagacaataagagagagaacctcaatgaggtagtatcggccttaacagcacaacaaatgcgttttgaacctgataacaaaaacactcaacgtaaagacccctattatggagcagactggggaatagggtggtggacagctgtagtgataatgttgatagtaggtataataacaccagtgttttatttgttgtattatgaaattttagctaaggtggatgttagtcatcattcaacagtggactcttcacatttacattcaaaaatcacacccccatcacagcagagagaaatggaaaatggaattgtgccaactaaaggaatacatttcagccaacaagatgatcataaactgtatagtcaagattctcagtcacctgctgctcaacaggaaacatagcaattagctcataatcaaatgttagtggtcacatgtgcatctggaatgtggtgaatcagttatatccaataatagcttcaaaggcagaatttagagagattgaggatgcttttgtttttaacaaaagggtttcacactttgaaaattttttgagcaactagttgttgatgttgagagcagttgatccataaatctggtgtgtgaatgtttcaagcagaaattaatttaaatgtgtgtttaggaagtacttaacttggaagatgtatcatttttcttaaaatgcatgtttaaattttatttttttaagtaatttttaaaaagtttattaatgttaaatttatgatgcagaatgatagcatcagatgtctgcagctgaaaaaaatttactactatgaacccccaaaatattcagttgcaagaaaatttgattctaaaattattcatggtaggatacgtaacacaccccttcaaaacttttaaaaaatacatttagcacatgtgctatgaaagcatacgtacaaagagaaaggggaaagtgatttataattcctacaacagaggccaagaaatagattaaaatattttcaagaccccaaaataatgtattatggttgggaagtcagtagaacactggaataggtgaagacctgacagtaatttttgtcttaagaatgctttctttaggacagaccctttaacctcacctctgtgcatctgtttttaaaatgattatatttgcctctgatatttgaaagcacttttgtagttttgatgatgaaaaatatattaaacgtgcatattaccattatttaggaaataattccttatatactgtgataaatcattgctgttacatacagtaacatgccttaattacatttaatgccttactgctttatgtaagtaaatccaagtttcagaattaaaaataagcattatttcatatggtccaatcagattcgttacataggctatataaatttgtctccattttcaccatcaagcacaaataattgggtcaaaactgcctttgaggtctgttgaagaaaatggttcattaagcaaaaaagagtagaggtattttatattagcagtaacagacaaattatttagtaatcccttaacctctgtttttcaaagagaaaatatccaatttagacttttttcctgatctctatatatagcatcaaattgggaaacaaaggccaaaggtgtatagattgcttgaaagggggtggtagtgcctctttttaagatctgttgagtcggctacagtctggctaagtaagaagcatttgcatactgattccatcatttaatctttaaaagtatgtgttttaaaaatgtaaccagaatgattcttcaatagaaatgagatttggtggagtctggattgcctgttttgtatataatatatacttaagatatataataccacctcattttctgggcattatttcctaattgttgatgtttcaggcttttgataagtcattttatatatttcaaatttaactcagaataagtaaatatttatggcaaatgcagttttatgtactttcaggagaagaccatcaggaaaagacaggacaaagaagtcaaacattaaagcccttgcaaatattagaggaccttagacaattaccaaaaagtgtttaatagggaagttgcaaatgattctcttagtaaattaaacatttaaaaagtagttttaatgtgccttgggcatcttgaaaagaagagtgtgatataatttatgcttagtgttaactggtcattttacattgtatttattaagtctgctgaaaaatgaggttttaaggaagaaaatgcagattattttagggtaaacaggccaggtgtcctttgaagaactttgtttacatcaaattgatgaaattacagtcagtgattccttactttttttgctagttgtactttgaaattgttatgggttcgttttccaaaatatgtaacttattttttaaaggaataaggtgtgctgtgtatttgttgattaaaaatcatttgtcttgcagagtatccttttttgaaggaaatatacatccttataacacatcaggtagttttcttttttctgtatttaaattatatatttgaattaattgaatataatttgagttacatataattctatataaaggttacatattgaattatggttctaatctgtttaggaaagaaatgaattttctaagcatttaatacatttggaataattttagtttctaaaaagtactaatgtaagttaagtttatatcaaatgcaaattaccttgtataactaacaagcacagttattgtttaacattatggattttaattgtgttgacacccttctttgaatttgttgctttacatgtgtgtctgtgtgtgtgtctgcatgtgtgcacgcatgtacttgtatgcaatgtaaaagtaacagcagaatcattgcatttggtttacttaaaattttggagttagcaagtaaacaaaaagctgatagttttatgaagtctcggttaaaataaaatttctttgctatctcactcctaggaagttatggagttcatattttcaaaagatatgttaaaaatggttacacactctgctggccacattaaaaattagaagactcatgttaaattatctcctccaaaggactttttatttacagcttttcttttcctggactctacctgcttggttcagtgtcctgaagagttatttaaatgaaccactacttagtaattagttcttttttaaagtatctacttctaaaattacctagttgaaaatatgaaggatatgcttagttttagaaatatcatgaagcaaggatctagtcagtgttacagggtaaaggtggagttttttaaagtctgtatttaaatggtgcactgatggattcatttttaatttgcattacaaaaatgttgctcaggtaatcagtattttcttccacgtatgtgcatattgcactgttagatcatagaaatatctgaatgctttaatttttatgtatgcaaaatctataaatcttttgtataatgtattttatacaaatgtaactgtagaacattgttagcatgtgtatctgtaaaaccagtttttaaaattttttgccccttatttttcatattttgaaagatctccaacatgtaataaagtttctcttattcaatctaaaaaaaaaaa

SEQ ID NO: 419879 - DNA, 3616 bp, Homo sapiens
gacgttggcggcagaggcggaggcggacggggtcagcccaaagcagaggctcggccatgaacttacccgggacagcggcggcggcggaccttttggccatcttctcgcagagtgctccctgctaacggggacagattttaacattatggcagggaggcatcagaatcgtagttttcctcttccaggagttcagtcaagtggtcaagtacatgcatttggaaattgttcagacagtgatattttggaggaggatgctgaagtgtatgaacttcgatccagaggaaaagagaaagtccgaagaagtacatcaagagatagacttgacgacattatagtattaacaaaagatatacaagaaggagatacattaaatgcaatagcccttcagtactgttgtacggtagcagatatcaagagagttaacaatctcatcagtgatcaagacttttttgcccttaggtctatcaaaattccagtaaaaaagttcagttccttgaccgaaacactttgtcctccaaaaggaagacagacttcacgtcattcatctgttcaatactcttccgaacaacaggaaattttgccagctaatgattctcttgcttacagtgactcagctggtagctttttaaaagaagtagaccgagacatagaacaaatagtaaagtgtacagacaataagagagagaacctcaatgaggtagtatcggccttaacagcacaacaaatgcgttttgaacctgataacaaaaacactcaacgtaaagacccctattatggagcagactggggaatagggtggtggacagctgtagtgataatgttgatagtaggtataataacaccagtgttttatttgttgtattatgaaattttagctaaggtggatgttagtcatcattcaacagtggactcttcacatttacattcaaaaatcacacccccatcacagcagagagaaatggaaaatggaattgtgccaactaaaggaatacatttcagccaacaagatgatcataaactgtatagtcaagattctcagtcacctgctgctcaacaggaaacatagcaattagctcataatcaaatgttagtggtcacatgtgcatctggaatgtggtgaatcagttatatccaataatagcttcaaaggcagaatttagagagattgaggatgcttttgtttttaacaaaagggtttcacactttgaaaattttttgagcaactagttgttgatgttgagagcagttgatccataaatctggtgtgtgaatgtttcaagcagaaattaatttaaatgtgtgtttaggaagtacttaacttggaagatgtatcatttttcttaaaatgcatgtttaaattttatttttttaagtaatttttaaaaagtttattaatgttaaatttatgatgcagaatgatagcatcagatgtctgcagctgaaaaaaatttactactatgaacccccaaaatattcagttgcaagaaaatttgattctaaaattattcatggtaggatacgtaacacaccccttcaaaacttttaaaaaatacatttagcacatgtgctatgaaagcatacgtacaaagagaaaggggaaagtgatttataattcctacaacagaggccaagaaatagattaaaatattttcaagaccccaaaataatgtattatggttgggaagtcagtagaacactggaataggtgaagacctgacagtaatttttgtcttaagaatgctttctttaggacagaccctttaacctcacctctgtgcatctgtttttaaaatgattatatttgcctctgatatttgaaagcacttttgtagttttgatgatgaaaaatatattaaacgtgcatattaccattatttaggaaataattccttatatactgtgataaatcattgctgttacatacagtaacatgccttaattacatttaatgccttactgctttatgtaagtaaatccaagtttcagaattaaaaataagcattatttcatatggtccaatcagattcgttacataggctatataaatttgtctccattttcaccatcaagcacaaataattgggtcaaaactgcctttgaggtctgttgaagaaaatggttcattaagcaaaaaagagtagaggtattttatattagcagtaacagacaaattatttagtaatcccttaacctctgtttttcaaagagaaaatatccaatttagacttttttcctgatctctatatatagcatcaaattgggaaacaaaggccaaaggtgtatagattgcttgaaagggggtggtagtgcctctttttaagatctgttgagtcggctacagtctggctaagtaagaagcatttgcatactgattccatcatttaatctttaaaagtatgtgttttaaaaatgtaaccagaatgattcttcaatagaaatgagatttggtggagtctggattgcctgttttgtatataatatatacttaagatatataataccacctcattttctgggcattatttcctaattgttgatgtttcaggcttttgataagtcattttatatatttcaaatttaactcagaataagtaaatatttatggcaaatgcagttttatgtactttcaggagaagaccatcaggaaaagacaggacaaagaagtcaaacattaaagcccttgcaaatattagaggaccttagacaattaccaaaaagtgtttaatagggaagttgcaaatgattctcttagtaaattaaacatttaaaaagtagttttaatgtgccttgggcatcttgaaaagaagagtgtgatataatttatgcttagtgttaactggtcattttacattgtatttattaagtctgctgaaaaatgaggttttaaggaagaaaatgcagattattttagggtaaacaggccaggtgtcctttgaagaactttgtttacatcaaattgatgaaattacagtcagtgattccttactttttttgctagttgtactttgaaattgttatgggttcgttttccaaaatatgtaacttattttttaaaggaataaggtgtgctgtgtatttgttgattaaaaatcatttgtcttgcagagtatccttttttgaaggaaatatacatccttataacacatcaggtagttttcttttttctgtatttaaattatatatttgaattaattgaatataatttgagttacatataattctatataaaggttacatattgaattatggttctaatctgtttaggaaagaaatgaattttctaagcatttaatacatttggaataattttagtttctaaaaagtactaatgtaagttaagtttatatcaaatgcaaattaccttgtataactaacaagcacagttattgtttaacattatggattttaattgtgttgacacccttctttgaatttgttgctttacatgtgtgtctgtgtgtgtgtctgcatgtgtgcacgcatgtacttgtatgcaatgtaaaagtaacagcagaatcattgcatttggtttacttaaaattttggagttagcaagtaaacaaaaagctgatagttttatgaagtctcggttaaaataaaatttctttgctatctc

SEQ ID NO: 419880 - DNA, 4207 bp, Homo sapiens
gacgttggcggcagaggcggaggcggacggggtcagcccaaagcagaggctcggccatgaacttacccgggacagcggcggcggcggaccttttggccatcttctcgcagagtgctccctgctaacggggacagattttaacattatggcagggaggcatcagaatcgtagttttcctcttccaggagttcagtcaagtggtcaagtacatgcatttggaaattgttcagacagtgatattttggaggaggatgctgaagtgtatgaacttcgatccagaggaaaagagaaagtccgaagaagtacatcaagagatagacttgacgacattatagtattaacaaaagatatacaagaaggagatacattaaatgcaatagcccttcagtactgttgtacggtctatcaaaattccagtaaaaaagttcagttccttgaccgaaacactttgtcctccaaaaggaagacagacttcacgtcattcatctgttcaatactcttccgaacaacaggaaattttgccagctaatgattctcttgcttacagtgactcagctggtagctttttaaaagaagtagaccgagacatagaacaaatagtaaagtgtacagacaataagagagagaacctcaatgaggtagtatcggccttaacagcacaacaaatgcgttttgaacctgataacaaaaacactcaacgtaaagacccctattatggagcagactggggaatagggtggtggacagctgtagtgataatgttgatagtaggtataataacaccagtgttttatttgttgtattatgaaattttagctaaggtggatgttagtcatcattcaacagtggactcttcacatttacattcaaaaatcacacccccatcacagcagagagaaatggaaaatggaattgtgccaactaaaggaatacatttcagccaacaagatgatcataaactgtatagtcaagattctcagtcacctgctgctcaacaggaaacatagcaattagctcataatcaaatgttagtggtcacatgtgcatctggaatgtggtgaatcagttatatccaataatagcttcaaaggcagaatttagagagattgaggatgcttttgtttttaacaaaagggtttcacactttgaaaattttttgagcaactagttgttgatgttgagagcagttgatccataaatctggtgtgtgaatgtttcaagcagaaattaatttaaatgtgtgtttaggaagtacttaacttggaagatgtatcatttttcttaaaatgcatgtttaaattttatttttttaagtaatttttaaaaagtttattaatgttaaatttatgatgcagaatgatagcatcagatgtctgcagctgaaaaaaatttactactatgaacccccaaaatattcagttgcaagaaaatttgattctaaaattattcatggtaggatacgtaacacaccccttcaaaacttttaaaaaatacatttagcacatgtgctatgaaagcatacgtacaaagagaaaggggaaagtgatttataattcctacaacagaggccaagaaatagattaaaatattttcaagaccccaaaataatgtattatggttgggaagtcagtagaacactggaataggtgaagacctgacagtaatttttgtcttaagaatgctttctttaggacagaccctttaacctcacctctgtgcatctgtttttaaaatgattatatttgcctctgatatttgaaagcacttttgtagttttgatgatgaaaaatatattaaacgtgcatattaccattatttaggaaataattccttatatactgtgataaatcattgctgttacatacagtaacatgccttaattacatttaatgccttactgctttatgtaagtaaatccaagtttcagaattaaaaataagcattatttcatatggtccaatcagattcgttacataggctatataaatttgtctccattttcaccatcaagcacaaataattgggtcaaaactgcctttgaggtctgttgaagaaaatggttcattaagcaaaaaagagtagaggtattttatattagcagtaacagacaaattatttagtaatcccttaacctctgtttttcaaagagaaaatatccaatttagacttttttcctgatctctatatatagcatcaaattgggaaacaaaggccaaaggtgtatagattgcttgaaagggggtggtagtgcctctttttaagatctgttgagtcggctacagtctggctaagtaagaagcatttgcatactgattccatcatttaatctttaaaagtatgtgttttaaaaatgtaaccagaatgattcttcaatagaaatgagatttggtggagtctggattgcctgttttgtatataatatatacttaagatatataataccacctcattttctgggcattatttcctaattgttgatgtttcaggcttttgataagtcattttatatatttcaaatttaactcagaataagtaaatatttatggcaaatgcagttttatgtactttcaggagaagaccatcaggaaaagacaggacaaagaagtcaaacattaaagcccttgcaaatattagaggaccttagacaattaccaaaaagtgtttaatagggaagttgcaaatgattctcttagtaaattaaacatttaaaaagtagttttaatgtgccttgggcatcttgaaaagaagagtgtgatataatttatgcttagtgttaactggtcattttacattgtatttattaagtctgctgaaaaatgaggttttaaggaagaaaatgcagattattttagggtaaacaggccaggtgtcctttgaagaactttgtttacatcaaattgatgaaattacagtcagtgattccttactttttttgctagttgtactttgaaattgttatgggttcgttttccaaaatatgtaacttattttttaaaggaataaggtgtgctgtgtatttgttgattaaaaatcatttgtcttgcagagtatccttttttgaaggaaatatacatccttataacacatcaggtagttttcttttttctgtatttaaattatatatttgaattaattgaatataatttgagttacatataattctatataaaggttacatattgaattatggttctaatctgtttaggaaagaaatgaattttctaagcatttaatacatttggaataattttagtttctaaaaagtactaatgtaagttaagtttatatcaaatgcaaattaccttgtataactaacaagcacagttattgtttaacattatggattttaattgtgttgacacccttctttgaatttgttgctttacatgtgtgtctgtgtgtgtgtctgcatgtgtgcacgcatgtacttgtatgcaatgtaaaagtaacagcagaatcattgcatttggtttacttaaaattttggagttagcaagtaaacaaaaagctgatagttttatgaagtctcggttaaaataaaatttctttgctatctcactcctaggaagttatggagttcatattttcaaaagatatgttaaaaatggttacacactctgctggccacattaaaaattagaagactcatgttaaattatctcctccaaaggactttttatttacagcttttcttttcctggactctacctgcttggttcagtgtcctgaagagttatttaaatgaaccactacttagtaattagttcttttttaaagtatctacttctaaaattacctagttgaaaatatgaaggatatgcttagttttagaaatatcatgaagcaaggatctagtcagtgttacagggtaaaggtggagttttttaaagtctgtatttaaatggtgcactgatggattcatttttaatttgcattacaaaaatgttgctcaggtaatcagtattttcttccacgtatgtgcatattgcactgttagatcatagaaatatctgaatgctttaatttttatgtatgcaaaatctataaatcttttgtataatgtattttatacaaatgtaactgtagaacattgttagcatgtgtatctgtaaaaccagtttttaaaattttttgccccttatttttcatattttgaaagatctccaacatgtaataaagtttctcttattcaatctaaaaaaaaaaa

SEQ ID NO: 419881 - DNA, 689 bp, Homo sapiens
ttacattgatctagattttttaatgcgactccctataagggaaattgggcccttgaaggccaaaaatttcggcacgaggagggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctgtgttttttaatataagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggattgtgtgtgtgtgtttaaagcatttgataaggtttaaatgttttttatacagagatttttgttcattaaactcaatctgcatcatggaaaaaaaaaa

SEQ ID NO: 419882 - DNA, 3712 bp, Homo sapiens
atgttcgccgggcaggcgaggaaagaggacgccatgattggttggcgctggggcggcggacggtggaagggcctggcgagtctaggttttacgcctgtgctggactttctccttccatgtttccaggccgtggggggctacagagggcgagaagtcggctcagcggaaacctggatttggttctaagccgtggggttgagaaggggtgaccggaagtgatcgtgggactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgccacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctgtgttttttaatataagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtttaaagcatttgataaggtttaaatgttttttatacagagatttttgttcattaaactcaatctgcatcatggaaaaaaaaaa

SEQ ID NO: 419883 - DNA, 3352 bp, Homo sapiens
gcaatggaagatgaaatgaatgaaatgaagcgagaagggaagtttagagaaaaaagaataaaaagaaatgagcaaagcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgccacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctgtgttttttaatataagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtttaaagcatttgataaggtttaaatgttttttatacagagatttttgttcattaaactcaatctgcatcatggaaaaaaaaaa

SEQ ID NO: 419884 - DNA, 3699 bp, Homo sapiens
atgttcgccgggcaggcgaggaaagaggacgccatgattggttggcgctggggcggcggacggtggaagggcctggcgagtctaggttttacgcctgtgctggactttctccttccatgtttccaggccgtggggggctacagagggcgagaagtcggctcagcggaaacctggatttggttctaagccgtggggttgagaaggggtgaccggaagtgatcgtgggactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgccacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctgtgttttttaatataagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggattgtgtgtgtgtgtttaaagcatttgataaggtttaaatgttttttatacagagatttttgttcattaaactcaatctgcatcatggaaaaaaaaaa

SEQ ID NO: 419885 - DNA, 2626 bp, Homo sapiens
atgttcgccgggcaggcgaggaaagaggacgccatgattggttggcgctggggcggcggacggtggaagggcctggcgagtctaggttttacgcctgtgctggactttctccttccatgtttccaggccgtggggggctacagagggcgagaagtcggctcagcggaaacctggatttggttctaagccgtggggttgagaaggggtgaccggaagtgatcgtgggactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcat

SEQ ID NO: 419886 - DNA, 2976 bp, Homo sapiens
tggatcccccgggctgcaggattcggcacgagggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgccacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctgtgttttttaatataagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtttaaagcatttgataaggtttaaatgttttttatacagagatttttgttcattaaactcaatctgcatcatggaaaaaaaaaa

SEQ ID NO: 419887 - DNA, 3478 bp, Homo sapiens
atgttcgccgggcaggcgaggaaagaggacgccatgattggttggcgctggggcggcggacggtggaagggcctggcgagtctaggttttacgcctgtgctggactttctccttccatgtttccaggccgtggggggctacagagggcgagaagtcggctcagcggaaacctggatttggttctaagccgtggggttgagaaggggtgaccggaagtgatcgtgggactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaagggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgccacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctgtgttttttaatataagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtttaaagcatttgataaggtttaaatgttttttatacagagatttttgttcattaaactcaatctgcatcatggaaaaaaaaaa

SEQ ID NO: 419888 - DNA, 2721 bp, Homo sapiens
tgacctagaggatccccgtatccgtacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgccacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctgtgttttttaatataagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtttaaagcatttgataaggtttaaatgttttttatacagagatttttgttcattaaactcaatctgcatcatggaaaaaaaaaa

SEQ ID NO: 419889 - DNA, 2694 bp, Homo sapiens
ttggggagaactacagaattcggtaaagacattgggggagacacatcctttcaccaaacttgtggttgatctgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgccacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctgtgttttttaatataagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtttaaagcatttgataaggtttaaatgttttttatacagagatttttgttcattaaactcaatctgcatcatggaaaaaaaaaa

SEQ ID NO: 419890 - DNA, 2032 bp, Homo sapiens
atgttcgccgggcaggcgaggaaagaggacgccatgattggttggcgctggggcggcggacggtggaagggcctggcgagtctaggttttacgcctgtgctggactttctccttccatgtttccaggccgtggggggctacagagggcgagaagtcggctcagcggaaacctggatttggttctaagccgtggggttgagaaggggtgaccggaagtgatcgtgggactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaaaagaaaaaaaaacccccc

SEQ ID NO: 419891 - DNA, 1139 bp, Homo sapiens
atgttcgccgggcaggcgaggaaagaggacgccatgattggttggcgctggggcggcggacggtggaagggcctggcgagtctaggttttacgcctgtgctggactttctccttccatgtttccaggccgtggggggctacagagggcgagaagtcggctcagcggaaacctggatttggttctaagccgtggggttgagaaggggtgaccggaagtgatcgtgggactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgatccacaatgatagcatctccagcaattgcttctataatgaatagcatgagtcattctgc

SEQ ID NO: 419892 - DNA, 1218 bp, Homo sapiens
atgttcgccgggcaggcgaggaaagaggacgccatgattggttggcgctggggcggcggacggtggaagggcctggcgagtctaggttttacgcctgtgctggactttctccttccatgtttccaggccgtggggggctacagagggcgagaagtcggctcagcggaaacctggatttggttctaagccgtggggttgagaaggggtgaccggaagtgatcgtgggactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgaggtgagtgagattttcccagaccctacaccttctgaataacaaaggcggatagacactaagaaaaggggttgagtgggaaggaggtgtatagagttttaaaaagctgtttacgattggggaaaagggacttgttcttttgtcgctttgagtagttagtgttgtggaagaaatggaaaaagcgattgtaggcgatatgaagcctgtgcagaatgcagtggaagataggaagtggtccctgattagtaaccagatgaatgttgagaggcttttgtgccaatgtgggagacttggggactgatggtgtatgtgtgggtaagtctgacgttgtgtgaagaagggttacatatagcataggaatggtatctaggaagttgggaaatt

SEQ ID NO: 419893 - DNA, 493 bp, Homo sapiens
tttaagagatggggtcttgctatgttgcccacgcctaacagtcttgaactcctaacagtcgattggcctcaacaatcctcctacctcagcttctcgagtagctgggactacaggcatgttgtgcccagcttagatagtggaaggttatttcaggcagaaagaacaacttgctcattagacatcatcagtatgatgaaagcatagggttaagtggggaggttaattggggggaattgagacgggagaggagctaggagccaggtcatgaagggccttatatgccatgaagaaaattatggattgtaacattctggtaatgaggtgtccttataatacagcccattttaatagtcattaacaaagagaatctttgcctttatcatccattttcttatatttattccaggggcagatttattgaaattaactagagatgatgtgatccaaatctgtggccctgcagatggaatcagactttttaatgcattaaaag

SEQ ID NO: 419894 - DNA, 633 bp, Homo sapiens
ggcttctgattgttgttactaatactaataatattattatactgttgtatattcaaccaactgaattttattctttccgaatctagcaaagttaatttgtggtgaatataatatgtaattactttttcttctaggacagtcttatgaaattcgaatgctagacaataggaaacttggagaacttccagaaattaatggcaaattggtgaaggtaaaacgaataaatcattcttctgtacaatattttttactaatccttttgggattttaaattttgttgttgttgttaatgttcttttgcttccaatggcttaatggtatctcttgcctgcagtaatttgttggcagagtagtaagctgatgtgttatttctttggggtcagagtaagccccagtattcacatgaatttttcagagctgcagaaatagaacgcttaccactccctgtccagggtaatcacccctggctcagtgaagttcttttgggtggagtaaagtaacctccttgagatctttagagaagcctcagtgtcttttttgatacttagtcttatagcaaggaaaacagaagctactttgatgaagagcagttctcttagtctagattaacagttaggattttgataattcaca

SEQ ID NO: 419895 - DNA, 2437 bp, Homo sapiens
atgttcgccgggcaggcgaggaaagaggacgccatgattggttggcgctggggcggcggacggtggaagggcctggcgagtctaggttttacgcctgtgctggactttctccttccatgtttccaggccgtggggggctacagagggcgagaagtcggctcagcggaaacctggatttggttctaagccgtggggttgagaaggggtgaccggaagtgatcgtgggactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacgggccaggattctgcctccatggcct

SEQ ID NO: 419896 - DNA, 3606 bp, Homo sapiens
cttgtaaggcagtagaaagtctgattccatctgcagggccacagatttggatcacatcatctctagttaatggcgataaatctgcccctgagaagtttgtgaaaagccttgtgaatgtagaaaaacgaggtcgatgcgaccactgctgagcttcctgaggtgtggttgttggtaagaggttatctgtgactggagggggtggctctggcagctggccgcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgccacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctgtgttttttaatataagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtttaaagcatttgataaggtttaaatgttttttatacagagatttttgttcattaaactcaatctgcatcatggaaaaaaaaaa

SEQ ID NO: 419897 - DNA, 3658 bp, Homo sapiens
atgttcgccgggcaggcgaggaaagaggacgccatgattggttggcgctggggcggcggacggtggaagggcctggcgagtctaggttttacgcctgtgctggactttctccttccatgtttccaggccgtggggggctacagagggcgagaagtcggctcagcggaaacctggatttggttctaagccgtggggttgagaaggggtgaccggaagtgatcgtgggactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaatatccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgccacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctgtgttttttaatataagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtttaaagcatttgataaggtttaaatgttttttatacagagatttttgttcattaaactcaatctgcatcatggaaaaaaaaaa

SEQ ID NO: 419898 - DNA, 3094 bp, Homo sapiens
atgttcgccgggcaggcgaggaaagaggacgccatgattggttggcgctggggcggcggacggtggaagggcctggcgagtctaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgccacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctgtgttttttaatataagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtttaaagcatttgataaggtttaaatgttttttatacagagatttttgttcattaaactcaatctgcatcatggaaaaaaaaaa

SEQ ID NO: 419899 - DNA, 3547 bp, Homo sapiens
gccaaaccttttcctaaactgttttatgtcattgtacattgctactgacaaaaggatgagagtgtggttttacattcccactgacaaaggatgggtatgtgtctttggtttgcaagtttagataaactgatagatacaaaaagctttttcttagaggaaatggcttgtaggaacatctcaatattagttgttattccacagaatgtaagatgaccttgaaatatatactcgttattgatttgtccttttcacgtggcttctaaggaattgtagaagttattttagtccttatagtaaatcagctgatatggttatatagatagtatagttgttgcctttctgagaatgaagacgttactgaatgtcctagatttatacattttagaactctgtttataatttccacagtccttttaggaacccctgtctatgattcctagaaacattctctttaacacttagtggttttagcagtgaatatctgtcatcacccacactgttgtggtcagggggatatcacagcaggtaatctaaatggaattcttgggatgaaactccaccaaggtgagtaatgtttatggctttccaaagcattgcagttaaatcattcagcaataaacctgcgtttgcaccattgccaggtattaatgtgagtcatttgttttattttagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgccacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctgtgttttttaatataagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtttaaagcatttgataaggtttaaatgttttttatacagagatttttgttcattaaactcaatctgcatcatggaaaaaaaaaa

SEQ ID NO: 419900 - DNA, 3663 bp, Homo sapiens
atgttcgccgggcaggcgaggaaagaggacgccatgattggttggcgctggggcggcggacggtggaagggcctggcgagtctaggttttacgcctgtgctggactttctccttccatgtttccaggccgtggggggctacagagggcgagaagtcggctcagcggaaacctggatttggttctaagccgtggggttgagaaggggtgaccggaagtgatcgtgggactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgccacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctgtgttttttaatataagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtttaaagcatttgataaggtttaaatgttttttatacagagatttttgttcattaaactcaatctgcatcatggaaaaaaaaaa

SEQ ID NO: 419901 - DNA, 2045 bp, Homo sapiens
tggcaggaaccgaaacccggagcggccgaagctcagcgctccgctggggcagagggtcgcggcggctgggaacgccgctccccgacgcaccggccgcccccagcgcagcgcgctccgcggggtgctgatctgcctcttctccaagaaactcaaccactagtgacaatgaccagcctcctgactactccttctccaagaggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgccacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctgtgttttttaatataagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtttaaagcatttgataaggtttaaatgttttttatacagagatttttgttcattaaactcaatctgcatcatggaaaaaaaaaa

SEQ ID NO: 419902 - DNA, 2056 bp, Homo sapiens
atgttcgccgggcaggcgaggaaagaggacgccatgattggttggcgctggggcggcggacggtggaagggcctggcgagtctaggttttacgcctgtgctggactttctccttccatgtttccaggccgtggggggctacagagggcgagaagtcggctcagcggaaacctggatttggttctaagccgtggggttgagaaggggtgaccggaagtgatcgtgggactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcat

SEQ ID NO: 419903 - DNA, 1429 bp, Homo sapiens
atgttcgccgggcaggcgaggaaagaggacgccatgattggttggcgctggggcggcggacggtggaagggcctggcgagtctaggttttacgcctgtgctggactttctccttccatgtttccaggccgtggggggctacagagggcgagaagtcggctcagcggaaacctggatttggttctaagccgtggggttgagaaggggtgaccggaagtgatcgtgggactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaatagggtttcatcatggagtttcactgctggagaggtagcgggaccccgagtgccactccagacctcagcccactgaccagtgccactcctagccagacgccagtgcgtctccgaagacaacagaaccaacgactccttcgagatacggcacggaccacaagccagttatggacgacatccccttgggggagctcacaggacccggtgagctggcacagccatccggcgcaaaactcatcgaagattctgttcactgggcaatccccaaagaagcaagggacctaccgagggaatccatgcacataccttgaagggcggaggcacgtccaggtgcgaagcgtgccaaaacgggaagacctgggagcacagagccatacacccgaagacagggacagctcaggaatcccag

SEQ ID NO: 419904 - DNA, 2475 bp, Homo sapiens
gatagtctcgatctcctgacctcgtgatccgcccgtctcggcctcccaaagtgctgggactgcaggcgtgagccaccgcgcccggccaacgtcattttcttttcaggagtcccttctgttatttagcaagacacactactacaatggagaaaaaagatgccccctccttcaagccctgagatcttcaggactttggcgaaaagtctgcgcccgaagagacccaggaaggattcttggaattgtagtccaaaggcatcccgccttctgcgcagactcacaagtccctgtggacggaattcttgaagtgtagcgccgctcagtccttccaccggaagtgtccgatcggaatcagccctgtccgagaggtgagtccgggtttggggatccagatgtccagccccgtgtccccctccaaacatccagtccctctcatattgcctttgaaattagcagcctctgggtgaccagaccttggccctcagaggaatcccggagaaaggtagaaccagcttcggcgttgggaacgcaggcgcgcttacgcatttagtgagggtttggcggtctccatagttaccgccgccgcgcgtgacgtcatagtggagcgctgagggcttggtggcgtggggtgggggctgtcctactgatcctgaatttggggtcactggtaagaggagttgcccattccagccaggtggaacggggaggggtagccacatgtctcagatctgccattgtctgcgaaaagaaactgctgcgaggaccatccccaatcccctgcttcccttgggaagagtaaccgccgttttgtaggacacttggggacaaccccgcttgtcctgaaatttattgacacggtaaatagtatttcctgtgtgccgaggatgcagttaaaccaacactgaccccctgcccttgagaaacacaagatggctacagaaccaaagaaagctgcagcccagaactctccagaggatgaaggacttctgatagtgaagatagaagaggaagaatttatccatgggcaggacacttgcttacagagaagtgaactccttaagcaggagctctgcaggcagctttttaggcagttctgctaccaggattctcctggacctcgcgaggcactgagccgcctccgggagctctgctgtcagtggctgaagccagagatccataccaaggaacagattctggaactgctggtgctagagcagttcctgaccatcctgccaggagatttgcaggcctgggtacatgaacattacccagagagtggagaggaggcagtgaccatactagaagatttggagagaggcactgatgaagcagtactccaggttcaagcccatgaacatggacaagaaatattccagaaaaaagtgtcacctcctggaccagcacttaatgtcaagttacagccagtggagaccaaggcccattttgattcatcagaaccccagctcctatgggactgtgataatgagagtgaaaacagtagatccatgccaaagctggaaatttttgaaaaaattgaatcacagagaattatatctggaagaatctcaggatacatatcagaagcatctggtgagtctcaagacatctgtaagtctgcaggcagggtaaagagacaatgggaaaaagaatcaggggagtctcagagactctcgtctgcccaggatgaaggttttggtaaaatcctcacccacaaaaatacagtcagaggtgaaataataagccacgatggatgtgagaggagattaaatctgaactcaaatgaattcacacaccagaaatcttgtaaacatggtacctgtgaccagagcttcaaatggaactcagattttattaaccatcaaataatttatgctggagaaaaaaatcaccaatatggaaaatctttcaagagcccaaaacttgctaaacatgcagcagttttcagtggagataaaactcatcagtgtaatgaatgtgggaaagctttcaggcacagctcaaaacttgctaggcatcagagaatccacactggagagagatgctatgaatgtaatgaatgtgggaaaagctttgcagagagctcagatcttactagacatcggcgaattcacactggggaaagaccctttggttgcaaagaatgtgggagagcattcaacctgaactcacatcttatcaggcatcagagaattcacaccagagagaaaccctacgagtgtagtgaatgtgggaaaaccttccgagtgagctcacatcttattcgacactttagaattcacactggagaaaaaccctatgaatgcagtgagtgtggaagagccttcagtcagagctcaaaccttagtcaacaccagagaattcacatgagggaaaacctattaatgtaaggaacttaaatttgtaagtaaatgctgaggaaatggcacaatatgaaaaatattaaataaaaaataaatattgggcaagatggaagactga

SEQ ID NO: 419905 - DNA, 2213 bp, Homo sapiens
gatagtctcgatctcctgacctcgtgatccgcccgtctcggcctcccaaagtgctgggactgcaggcgtgagccaccgcgcccggccaacgtcattttcttttcaggagtcccttctgttatttagcaagacacactactacaatggagaaaaaagatgccccctccttcaagccctgagatcttcaggactttggcgaaaagtctgcgcccgaagagacccaggaaggattcttggaattgtagtccaaaggcatcccgccttctgcgcagactcacaagtccctgtggacggaattcttgaagtgtagcgccgctcagtccttccaccggaagtgtccgatcggaatcagccctgtccgagaggtgagtccgggtttggggatccagatgtccagccccgtgtccccctccaaacatccagtccctctcatattgcctttgaaattagcagcctctgggtgaccagaccttggccctcagaggaatcccggagaaaggtagaaccagcttcggcgttgggaacgcaggcgcgcttacgcatttagtgagggtttggcggtctccatagttaccgccgccgcgcgtgacgtcatagtggagcgctgagggcttggtggcgtggggtgggggctgtcctactgatcctgaatttggggtcactgatggctacagaaccaaagaaagctgcagcccagaactctccagaggatgaaggacttctgatagtgaagatagaagaggaagaatttatccatgggcaggacacttgcttacagagaagtgaactccttaagcaggagctctgcaggcagctttttaggcagttctgctaccaggattctcctggacctcgcgaggcactgagccgcctccgggagctctgctgtcagtggctgaagccagagatccataccaaggaacagattctggaactgctggtgctagagcagttcctgaccatcctgccaggagatttgcaggcctgggtacatgaacattacccagagagtggagaggaggcagtgaccatactagaagatttggagagaggcactgatgaagcagtactccaggttcaagcccatgaacatggacaagaaatattccagaaaaaagtgtcacctcctggaccagcacttaatgtcaagttacagccagtggagaccaaggcccattttgattcatcagaaccccagctcctatgggactgtgataatgagagtgaaaacagtagatccatgccaaagctggaaatttttgaaaaaattgaatcacagagaattatatctggaagaatctcaggatacatatcagaagcatctggtgagtctcaagacatctgtaagtctgcaggcagggtaaagagacaatgggaaaaagaatcaggggagtctcagagactctcgtctgcccaggatgaaggttttggtaaaatcctcacccacaaaaatacagtcagaggtgaaataataagccacgatggatgtgagaggagattaaatctgaactcaaatgaattcacacaccagaaatcttgtaaacatggtacctgtgaccagagcttcaaatggaactcagattttattaaccatcaaataatttatgctggagaaaaaaatcaccaatatggaaaatctttcaagagcccaaaacttgctaaacatgcagcagttttcagtggagataaaactcatcagtgtaatgaatgtgggaaagctttcaggcacagctcaaaacttgctaggcatcagagaatccacactggagagagatgctatgaatgtaatgaatgtgggaaaagctttgcagagagctcagatcttactagacatcggcgaattcacactggggaaagaccctttggttgcaaagaatgtgggagagcattcaacctgaactcacatcttatcaggcatcagagaattcacaccagagagaaaccctacgagtgtagtgaatgtgggaaaaccttccgagtgagctcacatcttattcgacactttagaattcacactggagaaaaaccctatgaatgcagtgagtgtggaagagccttcagtcagagctcaaaccttagtcaacaccagagaattcacatgagggaaaacctattaatgtaaggaacttaaatttgtaagtaaatgctgaggaaatggcacaatatgaaaaatattaaataaaaaataaatattgggcaagatggaagactga

SEQ ID NO: 419906 - DNA, 1914 bp, Homo sapiens
gatagtctcgatctcctgacctcgtgatccgcccgtctcggcctcccaaagtgctgggactgcaggcgtgagccaccgcgcccggccaacgtcattttcttttcaggagtcccttctgttatttagcaagacacactactacaatggagaaaaaagatgccccctccttcaagccctgagatcttcaggactttggcgaaaagtctgcgcccgaagagacccaggaaggattcttggaattgtagtccaaaggcatcccgccttctgcgcagactcacaagtccctgtggacggaattcttgaagtgtagcgccgctcagtccttccaccggaagtgtccgatcggaatcagccctgtccgagagatggctacagaaccaaagaaagctgcagcccagaactctccagaggatgaaggacttctgatagtgaagatagaagaggaagaatttatccatgggcaggacacttgcttacagagaagtgaactccttaagcaggagctctgcaggcagctttttaggcagttctgctaccaggattctcctggacctcgcgaggcactgagccgcctccgggagctctgctgtcagtggctgaagccagagatccataccaaggaacagattctggaactgctggtgctagagcagttcctgaccatcctgccaggagatttgcaggcctgggtacatgaacattacccagagagtggagaggaggcagtgaccatactagaagatttggagagaggcactgatgaagcagtactccaggttcaagcccatgaacatggacaagaaatattccagaaaaaagtgtcacctcctggaccagcacttaatgtcaagttacagccagtggagaccaaggcccattttgattcatcagaaccccagctcctatgggactgtgataatgagagtgaaaacagtagatccatgccaaagctggaaatttttgaaaaaattgaatcacagagaattatatctggaagaatctcaggatacatatcagaagcatctggtgagtctcaagacatctgtaagtctgcaggcagggtaaagagacaatgggaaaaagaatcaggggagtctcagagactctcgtctgcccaggatgaaggttttggtaaaatcctcacccacaaaaatacagtcagaggtgaaataataagccacgatggatgtgagaggagattaaatctgaactcaaatgaattcacacaccagaaatcttgtaaacatggtacctgtgaccagagcttcaaatggaactcagattttattaaccatcaaataatttatgctggagaaaaaaatcaccaatatggaaaatctttcaagagcccaaaacttgctaaacatgcagcagttttcagtggagataaaactcatcagtgtaatgaatgtgggaaagctttcaggcacagctcaaaacttgctaggcatcagagaatccacactggagagagatgctatgaatgtaatgaatgtgggaaaagctttgcagagagctcagatcttactagacatcggcgaattcacactggggaaagaccctttggttgcaaagaatgtgggagagcattcaacctgaactcacatcttatcaggcatcagagaattcacaccagagagaaaccctacgagtgtagtgaatgtgggaaaaccttccgagtgagctcacatcttattcgacactttagaattcacactggagaaaaaccctatgaatgcagtgagtgtggaagagccttcagtcagagctcaaaccttagtcaacaccagagaattcacatgagggaaaacctattaatgtaaggaacttaaatttgtaagtaaatgctgaggaaatggcacaatatgaaaaatattaaataaaaaataaatattgggcaagatggaagactga

SEQ ID NO: 419907 - DNA, 2403 bp, Homo sapiens
gatagtctcgatctcctgacctcgtgatccgcccgtctcggcctcccaaagtgctgggactgcaggcgtgagccaccgcgcccggccaacgtcattttcttttcaggagtcccttctgttatttagcaagacacactactacaatggagaaaaaagatgccccctccttcaagccctgagatcttcaggactttggcgaaaagtctgcgcccgaagagacccaggaaggattcttggaattgtagtccaaaggcatcccgccttctgcgcagactcacaagtccctgtggacggaattcttgaagtgtagcgccgctcagtccttccaccggaagtgtccgatcggaatcagccctgtccgagaggtgagtccgggtttggggatccagatgtccagccccgtgtccccctccaaacatccagtccctctcatattgcctttgaaattagcagcctctgggtgaccagaccttggccctcagaggaatcccggagaaaggtagaaccagcttcggcgttgggaacgcaggcgcgcttacgcatttagtgagggtttggcggtctccatagttaccgccgccgcgcgtgacgtcatagtggagcgctgagggcttggtggcgtggggtgggggctgtcctactgatcctgaatttggggtcactggtaagaggagttgcccattccagccaggtggaacggggaggggtagccacatgtctcagatctgccattgtctgcgaaaagaaactgctgcgaggaccatccccaatcccctgcttcccttgggaagagtaaccgccgttttgtaggacacttggggacaaccccgcttgtcctgaaatttattgacacgatggctacagaaccaaagaaagctgcagcccagaactctccagaggatgaaggacttctgatagtgaagatagaagaggaagaatttatccatgggcaggacacttgcttacagagaagtgaactccttaagcaggagctctgcaggcagctttttaggcagttctgctaccaggattctcctggacctcgcgaggcactgagccgcctccgggagctctgctgtcagtggctgaagccagagatccataccaaggaacagattctggaactgctggtgctagagcagttcctgaccatcctgccaggagatttgcaggcctgggtacatgaacattacccagagagtggagaggaggcagtgaccatactagaagatttggagagaggcactgatgaagcagtactccaggttcaagcccatgaacatggacaagaaatattccagaaaaaagtgtcacctcctggaccagcacttaatgtcaagttacagccagtggagaccaaggcccattttgattcatcagaaccccagctcctatgggactgtgataatgagagtgaaaacagtagatccatgccaaagctggaaatttttgaaaaaattgaatcacagagaattatatctggaagaatctcaggatacatatcagaagcatctggtgagtctcaagacatctgtaagtctgcaggcagggtaaagagacaatgggaaaaagaatcaggggagtctcagagactctcgtctgcccaggatgaaggttttggtaaaatcctcacccacaaaaatacagtcagaggtgaaataataagccacgatggatgtgagaggagattaaatctgaactcaaatgaattcacacaccagaaatcttgtaaacatggtacctgtgaccagagcttcaaatggaactcagattttattaaccatcaaataatttatgctggagaaaaaaatcaccaatatggaaaatctttcaagagcccaaaacttgctaaacatgcagcagttttcagtggagataaaactcatcagtgtaatgaatgtgggaaagctttcaggcacagctcaaaacttgctaggcatcagagaatccacactggagagagatgctatgaatgtaatgaatgtgggaaaagctttgcagagagctcagatcttactagacatcggcgaattcacactggggaaagaccctttggttgcaaagaatgtgggagagcattcaacctgaactcacatcttatcaggcatcagagaattcacaccagagagaaaccctacgagtgtagtgaatgtgggaaaaccttccgagtgagctcacatcttattcgacactttagaattcacactggagaaaaaccctatgaatgcagtgagtgtggaagagccttcagtcagagctcaaaccttagtcaacaccagagaattcacatgagggaaaacctattaatgtaaggaacttaaatttgtaagtaaatgctgaggaaatggcacaatatgaaaaatattaaataaaaaataaatattgggcaagatggaagactga

SEQ ID NO: 419908 - DNA, 841 bp, Homo sapiens
cacacaaggattacttataccaatactttattttaaaatctctggaaatgagaccatctgaaatcagataaatatggcttcagataccagctctggcactactagttgcatgatcatcaatatgttacttctctgtgccttagtttccacatctgaaaattgagggtaagagtccctctctagatttgtgaatgggatgaacacaggattttaagtacggttagccagcatccaagatggcctcaatgatctctgcctctggtatttatgcccttgagtaatcccattccacatgtctcgggttggtctgtgtgtcttatagaatatggcttgaagtgaggttatgtggcttctgaagctatcacaatgtcataaaggacactgtgacttctgtcttgctccatttctggggtcacttgcactagaggaagtcagctactaaattacaaagaaattccagcaaccacaaggagaggtccacaaagtgagagattgaaccctcgagctaacaagcatgtgagtgagacatgttggaagtggattctccagctccagtcaagccttcagatgaatgcagctccagccaacatctcactgcagctttatgagagcctctgagctggagccactaggccaagctgttcccaaattcctgactctcagaaactgtgtgagttactataaatatatttgttgttttatactacaaagttttgggataattactaaggagcaatagataactaacacattaaggaaattagagcctagtactaggttccgttgggtaaaaggttagctattggattattaatttcttccatttgtctctcctgtttcc

SEQ ID NO: 419909 - DNA, 650 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtagggtacgccggggtgtgggcggggcagggaggccagaggactaagccgagccgcagcacttgtgagagggagaagtctgagtggcgctcgcggcggccgcgccagtcgcgtcccccaccccaacccccaccccaacggccgcaggcg

SEQ ID NO: 419910 - DNA, 3207 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaa

SEQ ID NO: 419911 - DNA, 3229 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaccacttttggcccagatcactgataataggaagaaatacaacttatacttttgtagcttatattaagcatgtggtgggtggaaagaaaagtttagtctgagtcactttggaaa

SEQ ID NO: 419912 - DNA, 3176 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaa

SEQ ID NO: 419913 - DNA, 3342 bp, Homo sapiens
cacacaaggattacttataccaatactttattttaaaatctctggaaatgagaccatctgaaatcagataaatatggcttcagataccagctctggcactactagttgcatgatcatcaatatgttacttctctgtgccttagtttccacatctgaaaattgagggtaagagtccctctctagatttgtgaatgggatgaacacaggattttaagtacggttagccagcatccaagatggcctcaatgatctctgcctctggtatttatgcccttgagtaatcccattccacatgtctcgggttggtctgtgtgtcttatagaatatggcttgaagtgaggttatgtggcttctgaagctatcacaatgtcataaaggacactgtgacttctgtcttgctccatttctggggtcacttgcactagaggaagtcagctactaaattacaaagaaattccagcaaccacaaggagaggtccacaaagtgagagattgaaccctcgagctaacaagcatgtgagtgagacatgttggaagtggattctccagctccagtcaagccttcagatgaatgcagctccagccaacatctcactgcagctttatgagagcctctgagctggagccactaggccaagctgttcccaaattcctgactctcagaaactgtgttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaa

SEQ ID NO: 419914 - DNA, 3109 bp, Homo sapiens
tgcgcgtgctgcgtccaacggcctcgcggggcaggagtaagccgcggccgccgcctgggccccagggcggtctctggggccaggggtcccgcgcccagcgtttcccgcccgccaccctctccgccacgcgcccgcggcaccttttcctcccctggccaagggatccagtcggttcggaccagaaggaggctttcgtttagggtgggggcagcactaaagtctgattggagtcttgcggtccgcgcgtcgcagaagcgccttcggttttgcagagagcaaagagggagcagcgagtgcacggagtggtagtaacaaccaatgttctttccacgccctcactgtgtgtccggcactgtgcggagccacttttctgcctttcatttgattcttgcagtgagctggcgaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaa

SEQ ID NO: 419915 - DNA, 3072 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaa

SEQ ID NO: 419916 - DNA, 2798 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaa

SEQ ID NO: 419917 - DNA, 3116 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgagagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaa

SEQ ID NO: 419918 - DNA, 2637 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaa

SEQ ID NO: 419919 - DNA, 2649 bp, Homo sapiens
tgcgcgtgctgcgtccaacggcctcgcggggcaggagtaagccgcggccgccgcctgggccccagggcggtctctggggccaggggtcccgcgcccagcgtttcccgcccgccaccctctccgccacgcgcccgcggcaccttttcctcccctggccaagggatccagtcggttcggaccagaaggaggctttcgtttagggtgggggcagcactaaagtctgattggagtcttgcggtccgcgcgtcgcagaagcgccttcggttttgcagagagcaaagagggagcagcgagtgcacggagtggtagtaacaaccaatgttctttccacgccctcactgtgtgtccggcactgtgcggagccacttttctgcctttcatttgattcttgcagtgagctggcgaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaaccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaa

SEQ ID NO: 419920 - DNA, 2624 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatggtcctcggtccttttgttgcgtttttcaattgtgttccccggatgccttgaaacatgctctagggtcttggccacatgtccctggtttttcggctccagagctataacggagagtgttttgggtgcctgtcgccattttacacacagactgcgcttgggcg

SEQ ID NO: 419921 - DNA, 2178 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccaagggaaaagaaaattaaggggagcttgaggcaggcatacaaaaacgggaatcaaaaaggaagggggaaatttatagagagagcttgggggaaacggggagagaggaacgagagaccggggaaaaaaagggataaagggagggaaaaaaagaaaacaaggagggggaggggaaaaaagggaggggaagaacaccaaaatggatgggaataagcaatgtaacggagaaagtaagg

SEQ ID NO: 419922 - DNA, 1666 bp, Homo sapiens
agacagtgtctcactatgttgcccagactggattcaaactcctaggctccagtgatcagctggcttcagcctcccaaagtgctgggattacaggcatgagtcaccgtgcccagcctctgctggttcattattacagctttctttatctttgatagtgatagccagctcatcagtactcttaagtctggtcaccttgattcttacagcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaa

SEQ ID NO: 419923 - DNA, 1971 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaagtaagagctcagaagggcgatttctcgtttgggggattttgaggtgagagcttattttgggagggcagttgatatttatatactttaaaataaaaatattgtagggttgatggaattacctgtttttagtgtagagggaaaactattgaatgtgagcagtcattgaaagatgtcttctttctcttgtctttcattgatgtttttgtctccttttaagtccgtgaggctggtgagcaaggtgacattgaaccccgaagaatggtgagacaccctgacagtcaccaactcttcattggcaacctgcctcatgaagtggacaaatcagagcttaaagatttctttcaaagtaggttattgagttttgaacactaaattcatctagtgtctctctagcactgtccagtagcaatagaaaatgagccacatatgtaattataaattttctagtagtcatggttaaaaa

SEQ ID NO: 419924 - DNA, 1740 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaa

SEQ ID NO: 419925 - DNA, 1519 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcaggtaagaagattttgttcacatgtccggggctgcataagaacttgcattgtctagtctttccctttgttggagggcatttacatattctgagaattacctcaaaataataatttctcagaagaatggttttgtttctggtaattttgactaaacaaaaatatgtaacttgtttgttaatagtaaattgtactatgaaggcaatctactattgcttagtttaaatagtatcagtttctttttggtttagttttttcttggtgttaagtgaaaacttgcatattgtttatcaagagttgaatgtattgaggtattaaatgctttgagggaatatgaagtggacagagacctatttaattagagatcgggcataaattgatataaataccaatatgtgagttaagtagcaataaagaatttcattacgtta

SEQ ID NO: 419926 - DNA, 1511 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaaccccgtccagagtctaagcctgaatctcagattccaccacaaagacctcagcgggatcaaagagtgcgagaacaacgaataaatattcctccccaaaggggacccagaccaagtaagagctcagaagggcgatttctcgtttgggggattttgaggtgagagcttattttgggagggcagttgatatttatatactttaaaataaaaatattgtagggttgatggaattacctgtttttagtgtagagggaaaactattgaatgtgagcagtcattgaaagatgtcttctttctcttgtctttcattgatgtttttgtctccttttaagtccgtgaggctggtgagcaaggtgacattgaaccccgaagaatggtgagacaccctgacagtcaccaactcttcattggcaacctgcctcatgaagtggacaaatcagagcttaaagatttctttcaaagtaggttattgagttttgaacactaaattcatctagtgtctctctagcactgtccagtagcaatagaaaatgagccacatatgtaattataaattttctagtagtcatggttaaaaa

SEQ ID NO: 419927 - DNA, 537 bp, Homo sapiens
tgacatataggacggaagagaagggtataagatggtttttaatgatttttcttgtgagggaattgtccattttgtagtttaaaacttgttagctaagaaacttcattaagaaaaaggataagcctgctttgttttaacacaaaagttaacttaaaatttttcagccccgtccagagtctaagcctgaatctcagattccaccacaaagacctcagcgggatcaaagagtgcgagaacaacgaataaatattcctccccaaaggggacccagaccaagtaagagctcagaagggcgatttctcgtttgggggattttgaggtgagagcttattttgggagggcagttgatatttatatactttaaaataaaaatattgtagggttgatggaattacctgtttttagtgtagagggaaaactattgaatgtgagcagtcattgaaagatgtcttctttctcttgtctttcattgatgtttttgtctccttttaagtccgtgaggctggtgagcaaggtgacattgaaccccgaagaatg

SEQ ID NO: 419928 - DNA, 512 bp, Homo sapiens
aaagagtgcgagaacaacgaataaatattcctccccaaaggggacccagaccaagtaagagctcagaagggcgatttctcgtttgggggattttgaggtgagagcttattttgggagggcagttgatatttatatactttaaaataaaaatattgtagggttgatggaattacctgtttttagtgtagagggaaaactattgaatgtgagcagtcattgaaagatgtcttctttctcttgtctttcattgatgtttttgtctccttttaagtccgtgaggctggtgagcaaggtgacattgaaccccgaagaatggtgagacaccctgacagtcaccaactcttcattggcaacctgcctcatgaagtggacaaatcagagcttaaagatttctttcaaagtaggttattgagttttgaacactaaattcatctagtgtctctctagcactgtccagtagcaatagaaaatgagccacatatgtaattataaattttctagtagtcatggtt

SEQ ID NO: 419929 - DNA, 458 bp, Homo sapiens
ttattggctactttgagtatcagtcaaagaactgctcactcgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtagggtacgccggggtgtgggcggggcagggaggccagaggactaagccgagccgcagcacttgtgagagggagaagtctgagt

SEQ ID NO: 419930 - DNA, 867 bp, Homo sapiens
gcggccgcctcgcagcgcccgccaagaagcgcctggcggaagggcgcactctcaggccttccaccggcgaccttccggcgggagcctgcgggcggcgcaggaacgaccctccttcctctgccccgcagcagtgctgagtaatggtgagagcagcaaggcccttggccgccgcacgttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggtatgtgtaggaatgattattttgtagtgatccaatacatgaaaaaagaaacaatgaactgttgtgcatatctttaaaaacacttgaaatttcagacttacagaaaacttggaataatagtacactaactcctatatactccttacctagagcagctgtcaccacttgcccacatgtgtataattctttctctaaaatagtttagtgggcatttcctaagaataattctcttccattctgtagtacagttatcaaattcaggaaatgttgatgcaatataatctataatccatttttaaaatttggaaattatctcaataatgt

SEQ ID NO: 419931 - DNA, 3722 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaagaaaatttaatctggcaatatagactaatactcgtttcacatatgtgttatttgttgagtgctgtgtgtgagatgggtgaaggttttgtttacacgtgtgaaacaaacttttgtgtgattgtcattactaattgaagggcaaccaggttgtaaaattcagcgtatttattttcttaacagtattcatctttaggactgtcgtttgaggatagcataggaatatttggtttgcattactgagaaactctaggtttgctgtgatggttaagaccacagtgaagttggtattaccagtttggttccagttcctcaaatatttgaaaattggcagcatctcctttacataaacttaatgtaactgaatcacatggcttttttgtagggttaaagtaactttggtaaccacttttggcccagatcactgataataggaagaaatacaacttatacttttgtagcttatattaagcatgtggtgggtggaaagaaaagtttagtctgagtcactttggaaa

SEQ ID NO: 419932 - DNA, 3237 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagaatgatatttctcaaattttcctgtcaaagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaa

SEQ ID NO: 419933 - DNA, 2815 bp, Homo sapiens
gcggccgcctcgcagcgcccgccaagaagcgcctggcggaagggcgcactctcaggccttccaccggcgaccttccggcgggagcctgcgggcggcgcaggaacgaccctccttcctctgccccgcagcagtgctgagtaatggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaa

SEQ ID NO: 419934 - DNA, 2996 bp, Homo sapiens
tgcgcgtgctgcgtccaacggcctcgcggggcaggagtaagccgcggccgccgcctgggccccagggcggtctctggggccaggggtcccgcgcccagcgtttcccgcccgccaccctctccgccacgcgcccgcggcaccttttcctcccctggccaagggatccagtcggttcggaccagaaggaggctttcgtttagggtgggggcagcactaaagtctgattggagtcttgcggtccgcgcgtcgcagaagcgccttcggttttgcagagagcaaagagggagcagcgagtgcacggagtggtagtaacaaccaatgttctttccacgccctcactgtgtgtccggcactgtgcggagccacttttctgcctttcatttgattcttgcagtgagctggcgaggttgaattgaccaaagcaatggtgatggagaagcctagtcccctgctggtcgggcgggaatttgtgagacagtattacacactgctgaaccaggccccagacatgctgcataggaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaa

SEQ ID NO: 419935 - DNA, 2044 bp, Homo sapiens
caactactgtactggctgagctatgtctgcaggtgctggagaagaactcttctgagcatcctcaggggcagcttcttctagggctggctcaggcttttcctcttgcatttcagatacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaa

SEQ ID NO: 419936 - DNA, 2491 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatgccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaa

SEQ ID NO: 419937 - DNA, 2723 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaa

SEQ ID NO: 419938 - DNA, 1754 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagtaggttattgagttttgaacactaaattcatctagtgtctctctagcactgtccagtagcaatagaaaatgagccacatatgtaattataaattttctagtagtcatggttaaaaa

SEQ ID NO: 419939 - DNA, 2163 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgcaggctggtgagaccagcgctgacagtttgaagcccccggaacacatgcgctgagacaacccctgaccagatcacacaaacatcctatcactatgggacaacactgcacatacactagacacgatgcgaacaacactcaaggacagcttaagagaatacatactcaaaagctcaatggacacacgccgcgaggaaaacaacacggaagaaccaccaagccaaacgaacacgacaaagggaccaccaaacccaagacgctccagacaccacaaaaccacacaacgatccacccagcaacactcgccaccacaccacgcacacaaaacacaaaacaacggcaccaccccaacaaccgcccggccaagaccgaccgaacacgaaaccacacaccccacacaaagagaacggcaacagacacgggacaacgcaagacgcaggccgagaccgacgcgcgcaacagagaacgagcagaaacacgaggcgagaaacaagcacggaacaacaaaggacccgaacagacgacagggaagccgaagccacagacagcggacagggagacgaagagggaagatcacaaaggagacacagacgacgaagggaacaagagaggaagagagacaagacgagacagagaaaagcacaaagccga

SEQ ID NO: 419940 - DNA, 1935 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaagaaaatttaatctggcaatatagactaatactcgtttcacatatgtgttatttgttgagtgctgtgtgtgagatgggtgaaggttttgtttacacgtgtgaaacaaacttttgtgtgattgtcattactaattgaagggcaaccaggttgtaaaattcagcgtatttattttcttaacagtattcatctttaggactgtcgtttgaggatagcataggaatatttggtttgcattactgagaaactctaggtttgctgtgatggttaagaccacagtgaagttggtattaccagtttggttccagttcctcaaatatttgaaaattggcagcatctcctttacataaacttaatgtaactgaatcacatggcttttttgtagggttaaagtaactttggtaaccacttttggcccagatcactgataataggaagaaatacaacttatacttttgtagcttatattaagcatgtggtgggtggaaagaaaagtttagtctgagtcactttggaaa

SEQ ID NO: 419941 - DNA, 1228 bp, Homo sapiens
tccaggctcgggctagccccgcgcagggaggcgagcgggcccggctccccagaggccgaggccggcgcccgtgctccttcagctcggcctctctcccccgacataggcgctccacatgcttcatttccaaaattctcagcaaaactccgcgggagaccctggtcacatgcctttctattgtacttttcggttattggtctctcttagtgccgatctgttactagggaaacgagatcctcacagtctcataggcaggagtcaaagccaatcaagagccacgccttcatccccgagtcagtgcccaattactgttcgaagagccctgaggacgcggtcgggattggtcatcccgtcgcccgacctggccgcaacaagttagggtgagtggcagttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggtatgtgtaggaatgattattttgtagtgatccaatacatgaaaaaagaaacaatgaactgttgtgcatatctttaaaaacacttgaaatttcagacttacagaaaacttggaataatagtacactaactcctatatactccttacctagagcagctgtcaccacttgcccacatgtgtataattctttctctaaaatagtttagtgggcatttcctaagaataattctcttccattctgtagtacagttatcaaattcaggaaatgttgatgcaatataatctataatccatttttaaaatttggaaattatctcaataatgt

SEQ ID NO: 419942 - DNA, 2770 bp, Homo sapiens
gtagcggggagaagactggagctccgaggagctgcatctgcggcaacctgtgtgctgacgctacgttcctcctggctccgacgtagctcgcagctccccagtctcactccattccttccccacctggcgcgcacctgctcaagaccagggtcctgccaagcgctaggagggcgcgtgccaggggcgctagggaactgcggagcgcgcgcgccatggggccgccgcctggggccggggtctcctgccgcggtggctgcggcttttccagattgctggcatggtgcttcctgctggccctgagtccgcaggcacccggttcccggggggctgaagcagtgtggaccgcgtacctcaacgtgtcctggcgggttccgcacacgggagtgaaccgtacggtgtgggagctgagcgaggagggcgtgtacggccaggactcgccgctggagcctgtggctggggtcctggtaccgcccgacgggcccggggcgcttaacgcctgtaacccgcacacgaatttcacggtgcccacggtttggggaagcaccgtgcaagtctcttggttggccctcatccaacgcggcgggggctgcaccttcgcagacaagatccatctggcttatgagagaggggcgtctggagccgtcatctttaacttccccgggacccgcaatgaggtcatccccatgtctcacccgggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcagaggcaattaaaggcagatgctaaaaaagctattggaaggcttcaactacgcacactgaaacaaggagacaaggaaattggccctgatggagatagttgtgctgtgtgcattgaattgtataaaccaaatgatttggtacgcatcttaacgtgcaaccatattttccataagacatgtgttgacccatggctgttagaacacaggacttgccccatgtgcaaatgtgacatactcaaagcttgggaattgaggtggatgttgaagatggatcagtgtctttacaagtccctgtatccaatgaaatatctaatagtgcctcctcccatgaagaggataatcgcagcgagaccgcatcatctggatatgcttcagtacagggaacagatgaaccgcctctggaggaacacgtgcagtcaacaaatgaaagtctacagctggtaaaccatgaagcaaattctgtggcagtggatgttattcctcatgttgacaacccaacctttgaagaagacgaaactcctaatcaagagactgctgttcgagaaattaaatcttaaaatctgtgtaaatagaaaacttgaaccattagtaataacagaactgccaatcagggcctagtttctattaataaattggataaatttaataaaataagagtgatactgaaagtgctcagatgactaatattatgctatagttaaatggcttaaaatatttaacctgttaacttttttccacaaactcattataatatttttcataggcaagtttcctctcagtagtgataacaacatttttagacattcaaaactgtcttcaagaagtcacgtttttcatttataacaattttcttataaaaacatgttgcttttaaaatgtggagtagctgtaatcactttattttatgatagtatcttaatgaaaaatactacttctttagcttgggctacatgtgtcagggtttttctccaggtgcttatattgatctggaattgtaatgtaaaaagcaatgcaaacttaggcgagtacttcttgaaatgtctatttaagctgctttaagttaatagaaaagattaaagcaaaatattcatttttactttttcttatttttaaaattaggctgaatgtacttcatgtgatttgtcaaccatagtttatcagagattatggacttaattgattggtatattagtgacatcaacttgacacaagattagacaaaaaattccttacaaaaatactgtgtaaaagctcagtatatgaatcatcatactgtttgaaattgctaatgacagagtaagtaacactaatattggtcattgatcttcgttcatgaattagtctacagaaaaaaaatgttctgtaaaattagtctgttgaaaatgttttccaaacaatgttactttgaaaattgagtttatgtttgacctaaatgggctaaaattacattagataaactaaaattctgtccgtgtaactataaattttgtgaatgcattttcctggtgtttgaaaaagaagggggggagaattccaggtgccttaatataaagtttgaagcttcatccaccaaagttaaatagagctatttaaaaatgcactttatttgtactctgtgtggcttttgttttagaattttgttcaaattatagcagaatttaggcaaaaataaaacagacatgtatttttgtttgctgaatggatgaaaccattgcattcttgtacactgatttgaaatgctgtaaatatgtcccaatttgtattgattctctttaaatataaaatgtaaataaaatattccaataaaagtttgtgtctggtgttagttt

SEQ ID NO: 419943 - DNA, 2799 bp, Homo sapiens
gtagcggggagaagactggagctccgaggagctgcatctgcggcaacctgtgtgctgacgctacgttcctcctggctccgacgtagctcgcagctccccagtctcactccattccttccccacctggcgcgcacctgctcaagaccagggtcctgccaagcgctaggagggcgcgtgccaggggcgctagggaactgcggagcgcgcgcgccatggggccgccgcctggggccggggtctcctgccgcggtggctgcggcttttccagattgctggcatggtgcttcctgctggccctgagtccgcaggcacccggttcccggggggctgaagcagtgtggaccgcgtacctcaacgtgtcctggcgggttccgcacacgggagtgaaccgtacggtgtgggagctgagcgaggagggcgtgtacggccaggactcgccgctggagcctgtggctggggtcctggtaccgcccgacgggcccggggcgcttaacgcctgtaacccgcacacgaatttcacggtgcccacggtttggggaagcaccgtgcaagtctcttggttggccctcatccaacgcggcgggggctgcaccttcgcagacaagatccatctggcttatgagagaggggcgtctggagccgtcatctttaacttccccgggacccgcaatgaggtcatccccatgtctcacccgggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcagaggcaattaaaggcagatgctaaaaaagctattggaaggcttcaactacgcacactgaaacaaggagacaaggaaattggccctgatggagatagttgtgctgtgtgcattgaattgtataaaccaaatgatttggtacgcatcttaacgtgcaaccatattttccataagacatgtgttgacccatggctgttagaacacaggacttgccccatgtgcaaatgtgacatactcaaagcttgggaattgaggtggatgttgaagatggatcagtgtctttacaagtccctgtatccaatgaaatatctaatagtgcctcctcccatgaagaggataatcgcagcgagaccgcatcatctggatatgcttcagtacagggaacagatgaaccgcctctggaggaacacgtgcagtcaacaaatgaaagtctacagctggtaaaccatgaagcaaattctgtggcagtggatgttattcctcatgttgacaacccaacctttgaagaagacgaaactcctaatcaagagactgctgttcgagaaattaaatcttaaaatctgtgtaaatagaaaacttgaaccattagtaataacagaactgccaatcagggcctagtttctattaataaattggataaatttaataaaataagagtgatactgaaagtgctcagatgactaatattatgctatagttaaatggcttaaaatatttaacctgttaacttttttccacaaactcattataatatttttcataggcaagtttcctctcagtagtgataacaacatttttagacattcaaaactgtcttcaagaagtcacgtttttcatttataacaattttcttataaaaacatgttgcttttaaaatgtggagtagctgtaatcactttattttatgatagtatcttaatgaaaaatactacttctttagcttgggctacatgtgtcagggtttttctccaggtgcttatattgatctggaattgtaatgtaaaaagcaatgcaaacttaggcgagtacttcttgaaatgtctatttaagctgctttaagttaatagaaaagattaaagcaaaatattcatttttactttttcttatttttaaaattaggctgaatgtacttcatgtgatttgtcaaccatagtttatcagagattatggacttaattgattggtatattagtgacatcaacttgacacaagattagacaaaaaattccttacaaaaatactgtgtaactatttctcaaacttgtgggatttttcaaaagctcagtatatgaatcatcatactgtttgaaattgctaatgacagagtaagtaacactaatattggtcattgatcttcgttcatgaattagtctacagaaaaaaaatgttctgtaaaattagtctgttgaaaatgttttccaaacaatgttactttgaaaattgagtttatgtttgacctaaatgggctaaaattacattagataaactaaaattctgtccgtgtaactataaattttgtgaatgcattttcctggtgtttgaaaaagaagggggggagaattccaggtgccttaatataaagtttgaagcttcatccaccaaagttaaatagagctatttaaaaatgcactttatttgtactctgtgtggcttttgttttagaattttgttcaaattatagcagaatttaggcaaaaataaaacagacatgtatttttgtttgctgaatggatgaaaccattgcattcttgtacactgatttgaaatgctgtaaatatgtcccaatttgtattgattctctttaaatataaaatgtaaataaaatattccaataaaagtttgtgtctggtgttagttt

SEQ ID NO: 419944 - DNA, 413 bp, Homo sapiens
tgtggggaagagggtgctggggcatggcaggctgggtgaccgactacccccgtccctttgctgtgtgttctggggcaacctactaatcctctctgcaagtcggtctccttatccccccaaatggaaattgtatttgccttctccactttgggaggctcccacttcttgggagggttacattttttaagtcttaatcatttgtgacatatgtatctatacatccgtatcttttaatgatccgtgtgtaccatctttgtgattatttccttaatattttttctttaagtcagttcattttcgttgaaatacatttatttaaagaaaaatctttgttactctgtaaatgaaaaaacccattttcgctataaataaaaggtaactgtacaaaataagtacaatgcaacaaaaaagtg

SEQ ID NO: 419945 - DNA, 4065 bp, Homo sapiens
tgtgactctagaggatcccctggatcctgcccatgtatcctcagcctcttcctccggccgcccccacgccctgcctgagatcagaccctacattaatatcaccatcctgaaggggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccatccaggacttcaagccctttgagaaccttcgcctgatggcccccatctccctccaagttgtccacgtggagacccacagatgcaacataagctgggaaatctcccaagcctcccactactttgaaagacacctggagttcgaggcccggacgctgtccccaggccacacctgggaggaggcccccctgctgactctcaagcagaagcaggaatggatctgcctggagacgctcaccccagacacccagtatgagtttcaggtgcgggtcaagcctctgcaaggcgagttcacgacctggagcccctggagccagcccctggccttcaggacaaagcctgcagcccttgggaaggacaccattccgtggctcggccacctcctcgtgggcctcagcggggcttttggcttcatcatcttagtgtacttgctgatcaactgcaggaacaccgggccatggctgaagaaggtcctgaagtgtaacaccccagacccctcgaagttcttttcccagctgagctcagagcatggaggagacgtccagaagtggctctcttcgcccttcccctcatcgtccttcagccctggcggcctggcacctgagatctcgccactagaagtgctggagagggacaaggtgacgcagctgctcctgcagcaggacaaggtgcctgagcccgcatccttaagcagcaaccactcgctgaccagctgcttcaccaaccagggttacttcttcttccacctcccggatgccttggagatagaggcctgccaggtgtactttacttacgacccctactcagaggaagaccctgatgagggtgtggccggggcacccacagggtcttccccccaacccctgcagcctctgtcaggggaggacgacgcctactgcaccttcccctccagggatgacctgctgctcttctcccccagtctcctcggtggccccagccccccaagcactgcccctgggggcagtggggccggtgaagagaggatgcccccttctttgcaagaaagagtccccagagactgggacccccagcccctggggcctcccaccccaggagtcccagacctggtggattttcagccaccccctgagctggtgctgcgagaggctggggaggaggtccctgacgctggccccagggagggagtcagtttcccctggtccaggcctcctgggcagggggagttcagggcccttaatgctcgcctgcccctgaacactgatgcctacttgtccctccaagaactccagggtcaggacccaactcacttggtgtagacagatggccagggtgggaggcaggcagctgcctgctctgcgccgagcctcagaaggaccctgttgagggtcctcagtccactgctgaggacactcagtgtccagttgcagctggacttctccacccggatggcccccacccagtcctgcacacttggtccatccatttccaaacctccactgctgctcccgggtcctgctgcccgagccaggaactgtgtgtgttgcaggggggcagtaactccccaactccctcgttaatcacaggatcccacgaatttaggctcagaagcatcgctcctctccagccctgcagctattcaccaatatcagtcctcgcggctctccagggctccctgccctgacctcttccctgggttttctgccccagcctcctccttccctcccctccccgtccacagggcagcctgagcgtgctttccaaaacccaaatatggccacgctccccctcggttcaaaaccttgcacaggtcccactgccctcagccccacttctcagcctggtacttgtacctccggtgtcgtgtggggacatccccttctgcaatcctccctaccgtcctcctgagccactcagagctccctcacaccccctctgttgcacatgctattccctggggctgctgtgcgctccccctcatctaggtgacaaacttccctgactcttcaagtgccggttttgcttctcctggagggaagcactgcctcccttaatctgccagaaacttctagcgtcagtgctggagggagaagctgtcagggacccagggcgcctggagaaagaggccctgttactattcctttgggatctctgaggcctcagagtgcttggctgctgtatctttaatgctggggcccaagtaagggcacagatccccccacaaagtggatgcctgctgcatcttcccacagtggcttcacagacccacaagagaagctgatggggagtaaaccctggagtccgaggcccaggcagcagccccgcctagtggtgggccctgatgctgccaggcctgggacctcccactgccccctccactggaggggtctcctctgcagctcagggactggcacactggcctccagaagggcagctccacagggcagggcctcattatttttcactgccccagacacagtgcccaacaccccgtcgtataccctggatgaacgaattaattacctggcaccacctcgtctgggctccctgcgcctgacattcacacagagaggcagagtcccgtgcccattaggtctggcatgccccctcctgcaaggggctcaaccccctaccccgacccctccacgtatctttcctaggcagatcacgttgcaatggctcaaacaacattccaccccagcaggacagtgaccccagtcccagctaactctgacctgggagccctcaggcacctgcacttacaggccttgctcacagctgattgggcacctgaccacacgcccccacaggctctgaccagcagcctatgagggggtttggcaccaagctctgtccaatcaggtaggctgggcctgaactagccaatcagatcaactctgtcttgggcgtttgaactcagggagggaggcccttgggagcaggtgcttgtggacaaggctccacaagcgttgagccttggaaaggtagacaagcgttgagccactaagcagaggaccttgggttcccaatacaaaaatacctactgctgagagggctgctgaccatttggtcaggattcctgttgcctttatatccaaaataaactcccctttcttgaggttgtctgagtcttgggtctatgccttgaaaaaagctgaattattggacagtctcacctcctgccatagggtcctgaatgtttcagaccacaaggggctccacacctttgctgtgtgttctggggcaacctactaatcctctctgcaagtcggtctccttatccccccaaatggaaattgtatttgccttctccactttgggaggctcccacttcttgggagggttacattttttaagtcttaatcatttgtgacatatgtatctatacatccgtatcttttaatgatccgtgtgtaccatctttgtgattatttccttaatattttttctttaagtcagttcattttcgttgaaatacatttatttaaagaaaaatctttgttactctgtaaatgaaaaaacccattttcgctataaataaaaggtaactgtacaaaataagtacaatgcaacaaaaaagtg

SEQ ID NO: 419946 - DNA, 3215 bp, Homo sapiens
gcagccagagctcagcagggccctggagagatggccacggtcccagcaccggggaggactggagagcgcgcgctgccaccgccccatgtctcagccagggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccatccaggacttcaagccctttgagaaccttcgcctgatggcccccatctccctccaagttgtccacgtggagacccacagatgcaacataagctgggaaatctcccaagcctcccactactttgaaagacacctggagttcgaggcccggacgctgtccccaggccacacctgggaggaggcccccctgctgactctcaagcagaagcaggaatggatctgcctggagacgctcaccccagacacccagtatgagtttcaggtgcgggtcaagcctctgcaaggcgagttcacgacctggagcccctggagccagcccctggccttcaggacaaagcctgcagcccttgggaaggacaccattccgtggctcggccacctcctcgtgggcctcagcggggcttttggcttcatcatcttagtgtacttgctgatcaactgcaggaacaccgggccatggctgaagaaggtcctgaagtgtaacaccccagacccctcgaagttcttttcccagctgagctcagagcatggaggagacgtccagaagtggctctcttcgcccttcccctcatcgtccttcagccctggcggcctggcacctgagatctcgccactagaagtgctggagagggacaaggtgacgcagctgctcctgcagcaggacaaggtgcctgagcccgcatccttaagcagcaaccactcgctgaccagctgcttcaccaaccagggttacttcttcttccacctcccggatgccttggagatagaggcctgccaggtgtactttacttacgacccctactcagaggaagaccctgatgagggtgtggccggggcacccacagggtcttccccccaacccctgcagcctctgtcaggggaggacgacgcctactgcaccttcccctccagggatgacctgctgctcttctcccccagtctcctcggtggccccagccccccaagcactgcccctgggggcagtggggccggtgaagagaggatgcccccttctttgcaagaaagagtccccagagactgggacccccagcccctggggcctcccaccccaggagtcccagacctggtggattttcagccaccccctgagctggtgctgcgagaggctggggaggaggtccctgacgctggccccagggagggagtcagtttcccctggtccaggcctcctgggcagggggagttcagggcccttaatgctcgcctgcccctgaacactgatgcctacttgtccctccaagaactccagggtcaggacccaactcacttggtgtagacagatggccagggtgggaggcaggcagctgcctgctctgcgccgagcctcagaaggaccctgttgagggtcctcagtccactgctgaggacactcagtgtccagttgcagctggacttctccacccggatggcccccacccagtcctgcacacttggtccatccatttccaaacctccactgctgctcccgggtcctgctgcccgagccaggaactgtgtgtgttgcaggggggcagtaactccccaactccctcgttaatcacaggatcccacgaatttaggctcagaagcatcgctcctctccagccctgcagctattcaccaatatcagtcctcgcggctctccagggctccctgccctgacctcttccctgggttttctgccccagcctcctccttccctcccctccccgtccacagggcagcctgagcgtgctttccaaaacccaaatatggccacgctccccctcggttcaaaaccttgcacaggtcccactgccctcagccccacttctcagcctggtacttgtacctccggtgtcgtgtggggacatccccttctgcaatcctccctaccgtcctcctgagccactcagagctccctcacaccccctctgttgcacatgctattccctggggctgctgtgcgctccccctcatctaggtgacaaacttccctgactcttcaagtgccggttttgcttctcctggagggaagcactgcctcccttaatctgccagaaacttctagcgtcagtgctggagggagaagctgtcagggacccagggcgcctggagaaagaggccctgttactattcctttgggatctctgaggcctcagagtgcttggctgctgtatctttaatgctggggcccaagtaagggcacagatccccccacaaagtggatgcctgctgcatcttcccacagtggcttcacagacccacaagagaagctgatggggagtaaaccctggagtccgaggcccaggcagcagccccgcctagtggtgggccctgatgctgccaggcctgggacctcccactgccccctccactggaggggtctcctctgcagctcagggactggcacactggcctccagaagggcagctccacagggcagggcctcattatttttcactgccccagacacagtgcccaacaccccgtcgtataccctggatgaacgaattaattacctggcaccacctcgtctgggctccctgcgcctgacattcacacagagaggcagagtcccgtgcccattaggtctggcatgccccctcctgcaaggggctcaaccccctaccccgacccctccacgtatctttcctaggcagggcctcattatttttcactgccccagacacagtgcccaacaccccgtcgtataccctggatgaacgaattaattacctggcac

SEQ ID NO: 419947 - DNA, 4050 bp, Homo sapiens
gcagccagagctcagcagggccctggagagatggccacggtcccagcaccggggaggactggagagcgcgcgctgccaccgccccatgtctcagccagggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccatccaggacttcaagccctttgagaaccttcgcctgatggcccccatctccctccaagttgtccacgtggagacccacagatgcaacataagctgggaaatctcccaagcctcccactactttgaaagacacctggagttcgaggcccggacgctgtccccaggccacacctgggaggaggcccccctgctgactctcaagcagaagcaggaatggatctgcctggagacgctcaccccagacacccagtatgagtttcaggtgcgggtcaagcctctgcaaggcgagttcacgacctggagcccctggagccagcccctggccttcaggacaaagcctgcagcccttgggaaggacaccattccgtggctcggccacctcctcgtgggcctcagcggggcttttggcttcatcatcttagtgtacttgctgatcaactgcaggaacaccgggccatggctgaagaaggtcctgaagtgtaacaccccagacccctcgaagttcttttcccagctgagctcagagcatggaggagacgtccagaagtggctctcttcgcccttcccctcatcgtccttcagccctggcggcctggcacctgagatctcgccactagaagtgctggagagggacaaggtgacgcagctgctcctgcagcaggacaaggtgcctgagcccgcatccttaagcagcaaccactcgctgaccagctgcttcaccaaccagggttacttcttcttccacctcccggatgccttggagatagaggcctgccaggtgtactttacttacgacccctactcagaggaagaccctgatgagggtgtggccggggcacccacagggtcttccccccaacccctgcagcctctgtcaggggaggacgacgcctactgcaccttcccctccagggatgacctgctgctcttctcccccagtctcctcggtggccccagccccccaagcactgcccctgggggcagtggggccggtgaagagaggatgcccccttctttgcaagaaagagtccccagagactgggacccccagcccctggggcctcccaccccaggagtcccagacctggtggattttcagccaccccctgagctggtgctgcgagaggctggggaggaggtccctgacgctggccccagggagggagtcagtttcccctggtccaggcctcctgggcagggggagttcagggcccttaatgctcgcctgcccctgaacactgatgcctacttgtccctccaagaactccagggtcaggacccaactcacttggtgtagacagatggccagggtgggaggcaggcagctgcctgctctgcgccgagcctcagaaggaccctgttgagggtcctcagtccactgctgaggacactcagtgtccagttgcagctggacttctccacccggatggcccccacccagtcctgcacacttggtccatccatttccaaacctccactgctgctcccgggtcctgctgcccgagccaggaactgtgtgtgttgcaggggggcagtaactccccaactccctcgttaatcacaggatcccacgaatttaggctcagaagcatcgctcctctccagccctgcagctattcaccaatatcagtcctcgcggctctccagggctccctgccctgacctcttccctgggttttctgccccagcctcctccttccctcccctccccgtccacagggcagcctgagcgtgctttccaaaacccaaatatggccacgctccccctcggttcaaaaccttgcacaggtcccactgccctcagccccacttctcagcctggtacttgtacctccggtgtcgtgtggggacatccccttctgcaatcctccctaccgtcctcctgagccactcagagctccctcacaccccctctgttgcacatgctattccctggggctgctgtgcgctccccctcatctaggtgacaaacttccctgactcttcaagtgccggttttgcttctcctggagggaagcactgcctcccttaatctgccagaaacttctagcgtcagtgctggagggagaagctgtcagggacccagggcgcctggagaaagaggccctgttactattcctttgggatctctgaggcctcagagtgcttggctgctgtatctttaatgctggggcccaagtaagggcacagatccccccacaaagtggatgcctgctgcatcttcccacagtggcttcacagacccacaagagaagctgatggggagtaaaccctggagtccgaggcccaggcagcagccccgcctagtggtgggccctgatgctgccaggcctgggacctcccactgccccctccactggaggggtctcctctgcagctcagggactggcacactggcctccagaagggcagctccacagggcagggcctcattatttttcactgccccagacacagtgcccaacaccccgtcgtataccctggatgaacgaattaattacctggcaccacctcgtctgggctccctgcgcctgacattcacacagagaggcagagtcccgtgcccattaggtctggcatgccccctcctgcaaggggctcaaccccctaccccgacccctccacgtatctttcctaggcagatcacgttgcaatggctcaaacaacattccaccccagcaggacagtgaccccagtcccagctaactctgacctgggagccctcaggcacctgcacttacaggccttgctcacagctgattgggcacctgaccacacgcccccacaggctctgaccagcagcctatgagggggtttggcaccaagctctgtccaatcaggtaggctgggcctgaactagccaatcagatcaactctgtcttgggcgtttgaactcagggagggaggcccttgggagcaggtgcttgtggacaaggctccacaagcgttgagccttggaaaggtagacaagcgttgagccactaagcagaggaccttgggttcccaatacaaaaatacctactgctgagagggctgctgaccatttggtcaggattcctgttgcctttatatccaaaataaactcccctttcttgaggttgtctgagtcttgggtctatgccttgaaaaaagctgaattattggacagtctcacctcctgccatagggtcctgaatgtttcagaccacaaggggctccacacctttgctgtgtgttctggggcaacctactaatcctctctgcaagtcggtctccttatccccccaaatggaaattgtatttgccttctccactttgggaggctcccacttcttgggagggttacattttttaagtcttaatcatttgtgacatatgtatctatacatccgtatcttttaatgatccgtgtgtaccatctttgtgattatttccttaatattttttctttaagtcagttcattttcgttgaaatacatttatttaaagaaaaatctttgttactctgtaaatgaaaaaacccattttcgctataaataaaaggtaactgtacaaaataagtacaatgcaacaaaaaagtg

SEQ ID NO: 419948 - DNA, 2293 bp, Homo sapiens
gagtacctcggagctgcgacctccagttcacaataccacctgcctcacacccgggctcatcttttcatcccacacccaccacccccctctccgttcacggtgtcccgggaggctgcgacctgcgtagatgatttagcagactgcccctgcccatgctcctgctcctgctcctcctcctcctcttccccgctctctccctctcgcctcctcttccagtccaggcgcccagactcggcgaacgcagcgccttgccaccagcggtgcctcgggctgcccggcgcgccgcgctcccaggttctgtctcgccgcaccccggcgggcactggcgcgggcaaggacgctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaagagtctcagtcgcccaggctggagtgcagcagcacagtctcacctcattgcaacctccgcctcccgggttcgcgggttctccgcctcagcttcctagtagctgggattgcaggcactcaccaccatgcccggctaattttttgaatttttagtggagacgggatttcaccatgttggccatgctggtcttgaacccccgacctcggatgattcgcccgcctcggcctcccaaagtgctggaattacaggcgaaccttcactcagaagaaatgctgtggcccttccctttaccaacagaaaatggaacacaagagaccacatagctgaacaaattatagcctccttacaagtgagaaaccttcgaggctacatagttttcagccaaaggaaaataaccaacagcttctccacagtgtagactgaaacaagggaaacatgaacatcacaaactgtaccacagaggccagcatggctataagacccaagaccatcactgagaagatgctcatttgcatgactctggtggtcatcaccaccctcaccacgttgctgaacttggctgtgatcatggctattggcaccaccaagaagctccaccagcctgccaactacctaatctgttctctggccgtgacggacctcctggtggcagtgctcgtcatgcccctgagcatcatctacattgtcatggatcgctggaagcttgggtacttcctctgtgaggtgtggctgagtgtggacatgacctgctgcacctgctccatcctccacctctgtgtcattgccctggacaggtactgggccatcaccaatgctattgaatacgccaggaagaggacggccaagagggccgcgctgatgatccttaccgtctggaccatctccattttcatctccatgccccctctgttctggagaagccaccgccgcctaagccctccccctagtcagtgcaccatccagcacgaccatgttatctacaccatttactccacgctgggtgcgttttatatccccttgactttgatactgattctctattaccggatttaccacgcggccaagagcctttaccagaaaaggggatcaagtcggcacttaagcaacagaagcacagatagccagaattcttttgcaagttgtaaacttacacagactttctgtgtgtctgacttctccacctcagaccctaccacagagtttgaaaagttccatgcctccatcaggatcccccccttcgacaatgatctagatcacccaggagaacgtcagcagatctctagcaccagggaacggaaggcagcacgcatcctggggctgattctgggtgcattcattttatcctggctgccatttttcatcaaagagttgattgtgggtctgagcatctacaccgtgtcctcggaagtggccgactttctgacgtggctcggttatgtgaattctctgatcaaccctctgctctatacgagttttaatgaagactttaagctggcttttaaaaagctcattagatgccgagagcatacttagactgtaaaaagctaaaaggcacgactttttccagagcctcatgagtggatgggggtaaggggtgcaacttattaattcttgaacatacttggttcaggagagtttgtaagtatgtgtggtcttgtttccttgtttgtttgtttgttttgttctgttttgtttgaggattgttatttggcgtgctgttttctacctctggtcttatctgtgatacataatttcaaataaacattatcatacaaaaacagaaa

SEQ ID NO: 419949 - DNA, 1036 bp, Homo sapiens
gagtacctcggagctgcgacctccagttcacaataccacctgcctcacacccgggctcatcttttcatcccacacccaccacccccctctccgttcacggtgtcccgggaggctgcgacctgcgtagatgatttagcagactgcccctgcccatgctcctgctcctgctcctcctcctcctcttccccgctctctccctctcgcctcctcttccagtccaggcgcccagactcggcgaacgcagcgccttgccaccagcggtgcctcgggctgcccggcgcgccgcgctcccaggttctgtctcgccgcaccccggcgggcactggcgcgggcaaggacgctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaaggtctttttctgatcccagaaagactaactaaaagtctggaacctttaaaagtctgataagaaatatttaccatctaatctctctgaagcctgctacttggaggattcatctgcataataagaaccctggtctccacaaccccttatcttcattcagacattcctttctatattgattccagttctttagataataacttaacactttcaaccaattgccaatcagaaaatctttaaatccacctataactggaagctgccctgccaccatcactgctttgagttgttctgcctttctggaccaaaccaatgtacaccttatatgtatcaattgatgtctgcttgtaacttctgaccccctaaaatgtataagaccaagctgtaacccaaccatctgcgtacatgttctccgaccctcctgaagctgtgtcattggcatgcccttattcttgacaaaataaacttctaaattgattgagaaaaaaaatttaaaaaaataaaaacctgattttcttggtcagagctgg

SEQ ID NO: 419950 - DNA, 2044 bp, Homo sapiens
gagtacctcggagctgcgacctccagttcacaataccacctgcctcacacccgggctcatcttttcatcccacacccaccacccccctctccgttcacggtgtcccgggaggctgcgacctgcgtagatgatttagcagactgcccctgcccatgctcctgctcctgctcctcctcctcctcttccccgctctctccctctcgcctcctcttccagtccaggcgcccagactcggcgaacgcagcgccttgccaccagcggtgcctcgggctgcccggcgcgccgcgctcccaggttctgtctcgccgcaccccggcgggcactggcgcgggcaaggacgctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaaggaaccttcactcagaagaaatgctgtggcccttccctttaccaacagaaaatggaacacaagagaccacatagctgaacaaattatagcctccttacaagtgagaaaccttcgaggctacatagttttcagccaaaggaaaataaccaacagcttctccacagtgtagactgaaacaagggaaacatgaacatcacaaactgtaccacagaggccagcatggctataagacccaagaccatcactgagaagatgctcatttgcatgactctggtggtcatcaccaccctcaccacgttgctgaacttggctgtgatcatggctattggcaccaccaagaagctccaccagcctgccaactacctaatctgttctctggccgtgacggacctcctggtggcagtgctcgtcatgcccctgagcatcatctacattgtcatggatcgctggaagcttgggtacttcctctgtgaggtgtggctgagtgtggacatgacctgctgcacctgctccatcctccacctctgtgtcattgccctggacaggtactgggccatcaccaatgctattgaatacgccaggaagaggacggccaagagggccgcgctgatgatccttaccgtctggaccatctccattttcatctccatgccccctctgttctggagaagccaccgccgcctaagccctccccctagtcagtgcaccatccagcacgaccatgttatctacaccatttactccacgctgggtgcgttttatatccccttgactttgatactgattctctattaccggatttaccacgcggccaagagcctttaccagaaaaggggatcaagtcggcacttaagcaacagaagcacagatagccagaattcttttgcaagttgtaaacttacacagactttctgtgtgtctgacttctccacctcagaccctaccacagagtttgaaaagttccatgcctccatcaggatcccccccttcgacaatgatctagatcacccaggagaacgtcagcagatctctagcaccagggaacggaaggcagcacgcatcctggggctgattctgggtgcattcattttatcctggctgccatttttcatcaaagagttgattgtgggtctgagcatctacaccgtgtcctcggaagtggccgactttctgacgtggctcggttatgtgaattctctgatcaaccctctgctctatacgagttttaatgaagactttaagctggcttttaaaaagctcattagatgccgagagcatacttagactgtaaaaagctaaaaggcacgactttttccagagcctcatgagtggatgggggtaaggggtgcaacttattaattcttgaacatacttggttcaggagagtttgtaagtatgtgtggtcttgtttccttgtttgtttgtttgttttgttctgttttgtttgaggattgttatttggcgtgctgttttctacctctggtcttatctgtgatacataatttcaaataaacattatcatacaaaaacagaaa

SEQ ID NO: 419951 - DNA, 2105 bp, Homo sapiens
gagtacctcggagctgcgacctccagttcacaataccacctgcctcacacccgggctcatcttttcatcccacacccaccacccccctctccgttcacggtgtcccgggaggctgcgacctgcgtagatgatttagcagactgcccctgcccatgctcctgctcctgctcctcctcctcctcttccccgctctctccctctcgcctcctcttccagtccaggcgcccagactcggcgaacgcagcgccttgccaccagcggtgcctcgggctgcccggcgcgccgcgctcccaggttctgtctcgccgcaccccggcgggcactggcgcgggcaaggacgctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaaggtgaggggcgcacaccttccgggacgaccttggcttcccttcttacccccacccactccaggaaccttcactcagaagaaatgctgtggcccttccctttaccaacagaaaatggaacacaagagaccacatagctgaacaaattatagcctccttacaagtgagaaaccttcgaggctacatagttttcagccaaaggaaaataaccaacagcttctccacagtgtagactgaaacaagggaaacatgaacatcacaaactgtaccacagaggccagcatggctataagacccaagaccatcactgagaagatgctcatttgcatgactctggtggtcatcaccaccctcaccacgttgctgaacttggctgtgatcatggctattggcaccaccaagaagctccaccagcctgccaactacctaatctgttctctggccgtgacggacctcctggtggcagtgctcgtcatgcccctgagcatcatctacattgtcatggatcgctggaagcttgggtacttcctctgtgaggtgtggctgagtgtggacatgacctgctgcacctgctccatcctccacctctgtgtcattgccctggacaggtactgggccatcaccaatgctattgaatacgccaggaagaggacggccaagagggccgcgctgatgatccttaccgtctggaccatctccattttcatctccatgccccctctgttctggagaagccaccgccgcctaagccctccccctagtcagtgcaccatccagcacgaccatgttatctacaccatttactccacgctgggtgcgttttatatccccttgactttgatactgattctctattaccggatttaccacgcggccaagagcctttaccagaaaaggggatcaagtcggcacttaagcaacagaagcacagatagccagaattcttttgcaagttgtaaacttacacagactttctgtgtgtctgacttctccacctcagaccctaccacagagtttgaaaagttccatgcctccatcaggatcccccccttcgacaatgatctagatcacccaggagaacgtcagcagatctctagcaccagggaacggaaggcagcacgcatcctggggctgattctgggtgcattcattttatcctggctgccatttttcatcaaagagttgattgtgggtctgagcatctacaccgtgtcctcggaagtggccgactttctgacgtggctcggttatgtgaattctctgatcaaccctctgctctatacgagttttaatgaagactttaagctggcttttaaaaagctcattagatgccgagagcatacttagactgtaaaaagctaaaaggcacgactttttccagagcctcatgagtggatgggggtaaggggtgcaacttattaattcttgaacatacttggttcaggagagtttgtaagtatgtgtggtcttgtttccttgtttgtttgtttgttttgttctgttttgtttgaggattgttatttggcgtgctgttttctacctctggtcttatctgtgatacataatttcaaataaacattatcatacaaaaacagaaa

SEQ ID NO: 419952 - DNA, 1896 bp, Homo sapiens
ttgtctcttaagtggggtcggaataaggttgtggctaggaagttcctgacaacccagggccagtgagtgtctcggaagcctgtgaggggcggagacccggcccggggaggtggagaagctcgccggccgcggaagactaggggtgaggctgctgcgaggaagacccggtcagctgtcccttcccccatcggtcctcttaggggaagtggagatgtgggcctcggagctgcgtggcccgggctgtgcggattccctaaacgccgcacttgcgcacagccccttacgtaaccgtcagtgccggggattccctggagggggtcattctattcaaccattatacacaccccgggctcctgccgccgcgccgccgccgcctcacaaaatggcggcgcccatagaggagaccgcggccgcctccccggccccattttgtgggaggcgagagatctgtcaacatggaaaacctctgctgaggatgcatccgagtttggaaaccccacttaagggatggagcctgggggatcacattaaacggaaaatgccaacgacttctaccacctctacgcgtttttagtttttcattttctcgaaggaagcgccagaagcctgtggagtaattgtaactagagggagaacggaaagctgaggtgactgctccggggacttggcgcggcgccttggtggctttggttgctcttccacgctcccggcagctgaccagaatctcttggagggtctcctgggccacctcggccgcgccagtcgtgcagtgagacttctgtagttttaaaatgccacagtccacggcccggtcggcaccgctcgcctgaatcgtgggctttgggaaccttggaggctgctgctccaggaactcgcggtcggccgggagccggggagcttcgttgctgggagcgggcggtattcgcggactccggcggccctggcgggtcgcggccgggatccgagccggggatgacgatgctgatggagctgatggggcaagagtgggaacggaggcacgtacactgaaatttaagtcatccaagttgggacttaagatagcaggttaatattgtctcaggcgagacttagaacgtcttttctggtatcccagtctgcagtgggcaaatctattgtctttatttctcatttaagggcagaatggagggatgacatatttttacttttcaagaggcggttgccacttttaagtcactgttgtgtgtgtgtgtgtacatacacaaacatacgatagtgtgttttcagagcaagtatcaaaggctaaagacttggagtgatactagtgtttaaaagcctttttaaaaaaattaagatgtgatgagaaactggagaattgacttttaaaaatttcttttctgtagaagaggctatcttcaaaatggagtcctaaagtatatctgatggatagaatttaaattcttaacactgtatataccctgtggtcaaaagcatcaacgtaaaacttgatgtttatcagattacttatgtttcaattttcctgtggttagaaaaattaagacagaagtaagctattaacggtatttgcttgtaagagtaacgttaaaggtttaaggaaaggtttgttgaaatcgatatgcatcacacgaatcatttattttcaatgttgttttccagttgcagcaatcatttgtgtttacatgactttgaaaaagggtttagtttatgttgattttgaccctcttatttaatctctagtgcagaagtgcagctttctgcaggctgcgcctcaatcgctaagttccactctccatcctctgccgcgctactcctggcatgtggatcaccaagatacaatttctggtcctgtctgttcttattgatgtcctttacagttaataaatttgattgccacta

SEQ ID NO: 419953 - DNA, 2202 bp, Homo sapiens
ttgtctcttaagtggggtcggaataaggttgtggctaggaagttcctgacaacccagggccagtgagtgtctcggaagcctgtgaggggcggagacccggcccggggaggtggagaagctcgccggccgcggaagactaggggtgaggctgctgcgaggaagacccggtcagctgtcccttcccccatcggtcctcttaggggaagtggagatgtgggcctcggagctgcgtggcccgggctgtgcggattccctaaacgccgcacttgcgcacagccccttacgtaaccgtcagtgccggggattccctggagggggtcattctattcaaccattatacacaccccgggctcctgccgccgcgccgccgccgcctcacaaaatggcggcgcccatagaggagaccgcggccgcctccccggccccattttgtgggaggcgagagatctgtcaacatggaaaacctctgctgaggatgcatccgagtttggaaaccccacttaagggatggagcctgggggatcacattaaacggaaaatgccaacgacttctaccacctctacgcgtttttagtttttcattttctcgaaggaagcgccagaagcctgtggagtaattgtaactagagggagaacggaaagctgaggtgactgctccggggacttggcgcggcgccttggtggctttggttgctcttccacgctcccggcagctgaccagaatctcttggagggtctcctgggccacctcggccgcgccagtcgtgcagtgagacttctgtagttttaaaatgccacagtccacggcccggtcggcaccgctcgcctgaatcgtgggctttgggaaccttggaggctgctgctccaggaactcgcggtcggccgggagccggggagcttcgttgctgggagcgggcggtattcgcggactccggcggccctggcgggtcgcggccgggatccgagccggggatgacgatgctgatggagctgatggggcaagagtgggaacggaggcacgtacactgaaatttaagtcatccaagttgggacttaagatagcaggttaatattgtctcaggcgagacttagaacgtcttttctggtatcccagtctgcagtgggcaaatctattgtctttatttctcatttaagggcagaatggagggatgacatatttttacttttcaagaggcggttgccacttttaagtcactgttgtgtgtgtgtgtgtacatacacaaacatacgatagtgtgttttcagagcaagtatcaaaggctaaagacttggagtgatactagtgtttaaaagcctttttaaaaaaattaagatgtgatgagaaactggagaattgacttttaaaaatttcttttctgtagaagaggctatcttcaaaatggagtcctaaagtatatctgatggatagaatttaaattcttaacactgtatataccctgtggtcaaaagcatcaacgtaaaacttgatgtttatcagattacttatgtttcaattttcctgtggttagaaaaattaagacagaagtaagctattaacggtatttgcttgtaagagtaacgttaaaggtttaaggaaaggtttgttgaaatcgatatgcatcacacgaatcatttattttcaatgttgttttccagttgcagcaatcatttgtgtttacatgactttgaaaaagggtttagtttatgttgattttgaccctcttatttaatctctagtgcagaagtgcagctttctgcaggctgcgcctcaatcgctaagttccactctccatcctctgccgcgctactcctggcatgtggatcaccaagatacaatttctggtcctgtctgttcttattgatgtcctttacagttaataaatttgattgccactaatcagtctgtatctcttgcaaaaacaccacatttagcatccaagtagagtcagagtatgttttttatgagattgtactaaagtaaccttctattacatttcttattaccatattgcatttcctatagtgggcagcatagagcaggtggatcctgacaaagtaatgttagagatgtgctgacagctttacaatagatattctccaactaatttgacaagatataaaataaaatgtagttcgtagttttcaagcattaatggaaagtgttcctattaaaaaattaccaataacagtggaaaaatgcaa

SEQ ID NO: 419954 - DNA, 1476 bp, Homo sapiens
ttgtctcttaagtggggtcggaataaggttgtggctaggaagttcctgacaacccagggccagtgagtgtctcggaagcctgtgaggggcggagacccggcccggggaggtggagaagctcgccggccgcggaagactaggggtgaggctgctgcgaggaagacccggtcagctgtcccttcccccatcggtcctcttaggggaagtggagatgtgggcctcggagctgcgtggcccgggctgtgcggattccctaaacgccgcacttgcgcacagccccttacgtaaccgtcagtgccggggattccctggagggggtcattctattcaaccattatacacaccccgggctcctgccgccgcgccgccgccgcctcacaaaatggcggcgcccatagaggagaccgcggccgcctccccggccccattttgtgggaggcgagagatctgtcaacatggaaaacctctgctgaggatgcatccgagtttggaaaccccacttaagggatggagcctgggggatcacattaaacggaaaatgccaacgacttctaccacctctacgcgtttttagtttttcattttctcgaaggaagcgccagaagcctgtggagtaattgtaactagagggagaacggaaagctgaggtgactgctccggggacttggcgcggcgccttggtggctttggttgctcttccacgctcccggcagctgaccagaatctcttggagggtctcctgggccacctcggccgcgccagtcgtgcagtgagacttctgtagttttaaaatgccacagtccacggcccggtcggcaccgctcgcctgaatcgtgggctttgggaaccttggaggctgctgctccaggaactcgcggtcggccgggagccggggagcttcgttgctgggagcgggcggtattcgcggactccggcggccctggcgggtcgcggccgggatccgagccggggatgacgatgctgatggagctgatggggcaagagtgggaacggagaagtgcagctttctgcaggctgcgcctcaatcgctaagttccactctccatcctctgccgcgctactcctggcatgtggatcaccaagatacaatttctggtcctgtctgttcttattgatgtcctttacagttaataaatttgattgccactaatcagtctgtatctcttgcaaaaacaccacatttagcatccaagtagagtcagagtatgttttttatgagattgtactaaagtaaccttctattacatttcttattaccatattgcatttcctatagtgggcagcatagagcaggtggatcctgacaaagtaatgttagagatgtgctgacagctttacaatagatattctccaactaatttgacaagatataaaataaaatgtagttcgtagttttcaagcattaatggaaagtgttcctattaaaaaattaccaataacagtggaaaaatgcaa

SEQ ID NO: 419955 - DNA, 1048 bp, Homo sapiens
ttgtctcttaagtggggtcggaataaggttgtggctaggaagttcctgacaacccagggccagtgagtgtctcggaagcctgtgaggggcggagacccggcccggggaggtggagaagctcgccggccgcggaagactaggggtgaggctgctgcgaggaagacccggtcagctgtcccttcccccatcggtcctcttaggggaagtggagatgtgggcctcggagctgcgtggcccgggctgtgcggattccctaaacgccgcacttgcgcacagccccttacgtaaccgtcagtgccggggattccctggagggggtcattctattcaaccattatacacaccccgggctcctgccgccgcgccgccgccgcctcacaaaatggcggcgcccatagaggagaccgcggccgcctccccggccccattttgtgggaggcgagagatctgtcaacatggaaaacctctgctgaggatgcatccgagtttggaaaccccacttaagggatggagcctgggggatcacattaaacggaaaatgccaacgacttctaccacctctacgcgtttttagtttttcattttctcgaaggaagcgccagaagcctgtggagtaattgtaactagagggagaacggaaagctgaggtgactgtcctggcatgtggatcaccaagatacaatttctggtcctgtctgttcttattgatgtcctttacagttaataaatttgattgccactaatcagtctgtatctcttgcaaaaacaccacatttagcatccaagtagagtcagagtatgttttttatgagattgtactaaagtaaccttctattacatttcttattaccatattgcatttcctatagtgggcagcatagagcaggtggatcctgacaaagtaatgttagagatgtgctgacagctttacaatagatattctccaactaatttgacaagatataaaataaaatgtagttcgtagttttcaagcattaatggaaagtgttcctattaaaaaattaccaataacagtggaaaaatgcaa

SEQ ID NO: 419956 - DNA, 10143 bp, Homo sapiens
  misc_feature (1)..(1): n is a, c, g, or t
  misc_feature (3)..(5): n is a, c, g, or t
  misc_feature (7)..(7): n is a, c, g, or t
  misc_feature (9)..(9): n is a, c, g, or t
  misc_feature (46)..(46): n is a, c, g, or t
  misc_feature (2574)..(2574): n is a, c, g, or t
  misc_feature (5466)..(5466): n is a, c, g, or t
  misc_feature (9882)..(9882): n is a, c, g, or t
ngnnnananagagtttcactctgttgcccaggctggagtgcagtgncgcaatctcggctcactgcagcctctgccctctgagttcaagtgattctcctgcctcagcctcctgagtagctgggattacaggtgtctgccaccgtgcccagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcatctgctttggagaacacagtttctaacagactttcaacagaggactgtcttattccactcttcagtgaagctttacgttcatgtaaacagcatgacgtgaggccatggatgcaggcattaaggtatactatgtaccagaatcagttgttggagaaaattaaagaacaaacagtcccaattagaagccatctcatggaattaggtctaacagcagcaaaatttgctagaaaacgagggaatgtgtcccttgcaacaagactgctggcacagtgcagtgaagttcagctgggaaagaccaccactgcacaggatttagtccaacattttaaaaaactatcaacccaaggtcaagtggatgaaaaatgggggcccgaacttgatattgaaaaaaccaaattgctttatacagcaggccagtcaacacatgcaatggaaatgttgagttcttgtgccatatctttctgcaagtctgtgaaagctgaatatgcagttgctaaatcaattctgacactggctaaatggatccaggcagaatggaaagagatttcaggacagctgaaacaggtttacagagctcagcaccaacagaacttcacaggtctttctactttgtctaaaaacatactcactctaatagaactgccatctgttaatacgatggaagaagagtatcctcggatcgagagtgaatctacagtgcatattggagttggagaacctgacttcattttgggacagttgtatcacctgtcttcagtacaggcacctgaagtagccaaatcttgggcagcgttggccagctgggcttataggtggggcagaaaggtggttgacaatgccagtcagggagaaggtgttcgtctgctgcctagagaaaaatctgaagttcagaatctacttccagacactataactgaggaagagaaagagagaatatatggtattcttggacaggctgtgtgtcggccggcggggattcaggatgaagatataacacttcagataactgagagtgaagacaacgaagaagatgacatggttgatgttatctggcgtcagttgatatcaagctgcccatggctttcagaacttgatgaaagtgcaactgaaggagttattaaagtgtggaggaaagttgtagatagaatattcagcctgtacaaactctcttgcagtgcatactttactttccttaaactcaacgctggtcaaattcctttagatgaggatgaccctaggctgcatttaagtcacagagtggaacagagcactgatgacatgattgtgatggccacattgcgcctgctgcggttgctcgtgaagcacgctggtgagcttcggcagtatctggagcacggcttggagacaacacccactgcaccatggagaggaattattccgcaacttttctcacgcttaaaccaccctgaagtgtatgtgcgccaaagtatttgtaaccttctctgccgtgtggctcaagattccccacatctcatattgtatcctgcaatagtgggtaccatatcgcttagtagtgaatcccaggcttcaggaaataaattttccactgcaattccaactttacttggcaatattcaaggagaagaattgctggtttctgaatgtgagggaggaagtcctcctgcatctcaggatagcaataaggatgaacctaaaagtggattaaatgaagaccaagccatgatgcaggattgttacagcaaaattgtagataagctgtcctctgcaaaccccaccatggtattacaggttcagatgctcgtggctgaactgcgcagggtcactgtgctctgggatgagctctggctgggagttttgctgcaacaacacatgtatgtcctgagacgaattcagcagcttgaagatgaggtgaagagagtccagaacaacaacaccttacgcaaagaagagaaaattgcaatcatgagggagaagcacacagctttgatgaagcccatcgtatttgctttggagcatgtgaggagtatcacagcggctcctgcagaaacacctcatgaaaaatggtttcaggataactatggtgatgccattgaaaatgccctagaaaaactgaagactccattgaaccctgcaaagcctgggagcagctggattccatttaaagagataatgctaantttgcaacagagagcacagaaacgtgcaagttacatcttgcgtcttgaagaaatcagtccatggttggctgccatgactaacactgaaattgctcttcctggggaagtctcagccagagacactgtcacaatccatagtgtgggcggaaccatcacaatcttaccgactaaaaccaagccaaagaaacttctctttcttggatcagatgggaagagctatccttatcttttcaaaggactggaggatttacatctggatgagagaataatgcagttcctatctattgtgaataccatgtttgctacaattaatcgccaagaaacaccccggttccatgctcgacactattctgtaacaccactaggaacaagatcaggactaatccagtgggtagatggagccacacccttatttggtctttacaaacgatggcaacaacgggaagctgccttacaagcacaaaaggcccaagattcctaccaaactcctcagaatcctggaattgtaccccgtcctagtgaactttattacagtaaaattggccctgctttgaaaacagttgggcttagcctggatgtgtcccgtcgggattggcctcttcatgtaatgaaggcagtattggaagagttaatggaggccacacccccgaatctccttgccaaagagctctggtcatcttgcacaacacctgatgaatggtggagagttacgcagtcttatgcaagatctactgcagtcatgtctatggttggatacataattggccttggagacagacatctggataatgttcttatagatatgacgactggagaagttgttcacatagattacaatgtttgctttgaaaaaggtaaaagccttagagttcctgagaaagtaccttttcgaatgacacaaaacattgaaacagcactgggtgtaactggagtagaaggtgtatttaggctttcatgtgagcaggttttacacattatgcggcgtggcagagagaccctgctgacgctgctggaggcctttgtgtacgaccctctggtggactggacagcaggaggcgaggctgggtttgctggtgctgtctatggtggaggtggccagcaggccgagagcaagcagagcaagagagagatggagcgagagatcacccgcagcctgttttcttctagagtagctgagattaaggtgaactggtttaagaatagagatgagatgctggttgtgcttcccaagttggacggtagcttagatgaatacctaagcttgcaagagcaactgacagatgtggaaaaactgcagggcaaactactggaggaaatagagtttctagaaggagctgaaggggtggatcatccttctcatactctgcaacacaggtattctgagcacacccaactacagactcagcaaagagctgttcaggaagcaatccaggtgaagctgaatgaatttgaacaatggataacacattatcaggctgcattcaataatttagaagcaacacagcttgcaagcttgcttcaagagataagcacacaaatggaccttggtcctccaagttacgtgccagcaacagcctttctgcagaatgctggtcaggcccacttgattagccagtgcgagcagctggagggggaggttggtgctctcctgcagcagaggcgctccgtgctccgtggctgtctggagcaactgcatcactatgcaaccgtggccctgcagtatccgaaggccatatttcagaaacatcgaattgaacagtggaagacctggatggaagagctcatctgtaacaccacagtagagcgttgtcaagagctctataggaaatatgaaatgcaatatgctccccagccacccccaacagtgtgtcagttcatcactgccactgaaatgaccctgcagcgatacgcagcagacatcaacagcagacttattagacaagtggaacgcttgaaacaggaagctgtcactgtgccagtttgtgaagatcagttgaaagaaattgaacgttgcattaaagttttccttcatgagaatggagaagaaggatctttgagtctagcaagtgttattatttctgccctttgtacccttacaaggcgtaacctgatgatggaaggtgcagcgtcaagtgctggagaacagctggttgatctgacttctcgggatggagcctggttcttggaggaactctgcagtatgagcggaaacgtcacctgcttggttcagttactgaagcagtgccacctggtgccacaggacttagatatcccgaaccccatggaagcgtctgagacagttcacttagccaatggagtgtatacctcacttcaggaattgaattcgaatttccggcaaatcatatttccagaagcacttcgatgtttaatgaaaggggaatacacgttagaaagtatgctgcatgaactggacggtcttattgagcagaccaccgatggcgttcccctgcagactctagtggaatctcttcaggcctacttaagaaacgcagctatgggactggaagaagaaacacatgctcattacatcgatgttgccagactactacatgctcagtacggtgaattaatccaaccgagaaatggttcagttgatgaaacacccaaaatgtcagctggccagatgcttttggtagcattcgatggcatgtttgctcaagttgaaactgctttcagcttattagttgaaaagttgaacaagatggaaattcccatagcttggcgaaagattgacatcataagggaagccaggagtactcaagttaatttttttgatgatgataatcaccggcaggtgctagaagagattttctttctaaaaagactacagactattaaggagttcttcaggctctgtggtaccttttctanaacattgtcaggatcaagttcacttgaagatcagaatactgtgaatgggcctgtacagattgtcaatgtgaaaaccctttttagaaactcttgtttcagtgaagaccaaatggccaaacctatcaaggcattcacagctgactttgtgaggcagctcttgatagggctacccaaccaagccctcggactcacactgtgcagttttatcagtgctctgggtgtagacatcattgctcaagtagaggcaaaggactttggtgccgaaagcaaagtttctgttgatgatctctgtaagaaagcggtggaacataacatccagatagggaagttctctcagctggttatgaacagggcaactgtgttagcaagttcttacgacactgcctggaagaagcatgacttggtgcgaaggctagaaaccagtatttcttcttgtaagacaagcctgcagcgggttcagctgcatattgccatgtttcagtggcaacatgaagatctacttatcaatagaccacaagccatgtcagtcacacctcccccacggtctgctatcctaaccagcatgaaaaagaagctgcataccctgagccagattgaaacttctattgcgacagttcaggagaagctagctgcacttgaatcaagtattgaacagcgactcaagtgggcaggtggtgccaaccctgcattggcccctgtactacaagattttgaagcaacgatagctgaaagaagaaatcttgtccttaaagagagccaaagagcaagtcaggtcacatttctctgcagcaatatcattcattttgaaagtttacgaacaagaactgcagaagccttaaacctggatgcggcgttatttgaactaatcaagcgatgtcagcagatgtgttcgtttgcatcacagtttaacagttcagtgtctgagttagagcttcgtttattacagagagtggacactggtcttgaacatcctattggcagctctgaatggcttttgtcagcacacaaacagttgacccaggatatgtctactcagagggcaattcagacagagaaagagcagcagatagaaacggtctgtgaaacaattcagaatctggttgataatataaagactgtgctcactggtcataaccgacagcttggagatgtcaaacatctcttgaaagctatggctaaggatgaagaagctgctctggcagatggtgaagatgttccctatgagaacagtgttaggcagtttttgggtgaatataaatcatggcaagacaacattcaaacagttctatttacattagtccaggctatgggtcaggttcgaagtcaagaacacgttgaaatgctccaggaaatcactcccaccttgaaagaactgaaaacacaaagtcagagtatctataataatttagtgagttttgcatcacccttagtcaccgatgcaacaaatgaatgttcgagtccaacgtcatctgctacttatcagccatccttcgctgcagcagtccggagtaacactggccagaagactcagcctgatgtcatgtcacagaatgctagaaagctgatccagaaaaatcttgctacatcagctgatactccaccaagcaccgttccaggaactggcaagagtgttgcttgtagtcctaaaaaggcagtcagagaccctaaaactgggaaagcggtgcaagagagaaactcctatgcagtgagtgtgtggaagagagtgaaagccaagttagagggccgagatgttgatccgaataggaggatgtcagttgctgaacaggttgactatgtcattaaggaagcaactaatctagataacttggctcagctgtatgaaggttggacagcctgggtgtgaatggcaagacagtagatgagtctggttaagcgaggtcagacatccaccagaatcaactcagcctcaggcatccaaagccacaccacagtcggtggtgatgcaactgggggcttactctgaggaaacctaggaaatctcggtgcactaggaagtgaatcccgcaggacagctgcactcagggatacgcccaacaccatggcctgcaaccccagggtcaagggtgaaggaaagcaagctcaccgcctgaacacggagattgtctttctgccacagaacagcagcagacgtgtcgggaggttagctgcggaaagaaatcgggatgccgcggagcacagagtgatttggaactccattccacctgaccctgtgtgtacaatccaggaaaaaaacaaaccccactcagaaacagagaaaactggggtcgcgaagaaatcacagccaaggaagatttgatgcattcagattctcgtgtaacacttgttgcttggcaacagtactggttgggttgaccagtaagtagaaaaaggctaaaggctatgcgatatgaatttcagaaatggactgaaaatggagagctatgtaacagatacactacagtagaagaacttacttctgaaatgaagggaaaaaaaccaccccatcgttccctactcctccccaccacttacccgttccccctttacctaatctagtagattagccatctttcaaattcacttttatttcagtccttatatttcatatacttccgtctcgatgctgttaacaacttctgataacatggaaaattcaaggattgtttaaaggtctgatgatcacacacaaaatgtaattccggttatttaagtcatttctgtgattctatcatgtacagtttccagaattgtcactgtgcattcaaaagtaatgaatctaacagacatttgatttaatgtacactcccttttgcttatagtgtgcattttttttggaggtcattcaaattttccctcttctgtgatagctgtagtttctttcatagaaagtagctaatccagtgtaatcttttacctttttaaaaaccaagatagagtatctattagagttttacattgttgatgatagattaacaataaagtgatgttctggtggaggtagactgaaatttttttaattcatgtttttcatttgatacttttaatttacacttagtaaattaaaagttgtttaatttacttggcattttaggacatgtacatgaaacagtgaaaatgagatccaccaacatcttttattaagttcagttattagtctgtgaagtgctttactttttgcacaattttaatagcttgctattcagtaatacattatagtgaattcatgatcaaggtttccttaaatttagcattgcatttcagtactgactgtgtaagctaaattgctgatccaaaataaaaacccagactagaatagggttcttaaaatcaagtatcaatacaaaatagaacacaattaaaatcttaattgttggctgggcacagtggctcacgcctgtaatcccagcactttgggaggccgaggcgggcggatcatgaggttaggagagcgagaccatcctggctaacacggtgaaaccccgtctttactaaaaatacaaaaaaaattagccgggcgtggtggcgggcgcctgtagtcccagctactcgggaggctgaggcaggagaatggcgtgaacccaggaggcggagcttgcagtgagccgagattgtgccactgcactccagcctgggcaacagagctagactctgtgtcaaaaataaatgactagataaaaaaaaaaattgtttgagtacattttccctgcattttagagattaggacagtggtcactttctagttgccgtcttcacagacaaacttgaaaggtattaaggaaaaaattccacatagctctgggcctttttggtattctgattgccacgttaatctgtaatcgttaagtacccatgaaagaatgtgtttcagtatcagtgctttttgggtactttaacaagtattgtaggcacggtggatttttttgaaatacccatgtgtccaatagcaagttaaggaacctagcgcatcaaatttggttttcttcattcatttggaaccttattttcgcaaaaaacctagctggaataataatgccatattgtattttgcacactgctttattttctagaggctctgggagcaaattacattcatcacattacctctgctctctcaagattaaagtctttcagcaacattctttattgtcatcataaggaaaaacttttatcgcaatgatagtcagttcacattagtttagcactatagatagtattcagaaattgctttctctttggtaaagaagataaataggtgaattttattgcctgttttttcaggcttcagaggtacctggcaccttactcaagcaaaaacaaaaaacagctttacttcaaaagcatgtgcctctggtaaattatccatcacttttgttttaaagtggtccctccaagaataatgtggcatacacagtgggntttggttgtaacggcagatgtaatagatgacttcaaaagcctgctccttactgcactctggacgaggccctggtctgtatagtttggcttcctctgttaagtcattctacaaggtgacttgccatttgaactttcgtaagagacctcagcagttagactgagaaaagttagagtgctgtagttatgaagtcatacatttttgataaaatacctgtggaaaaccagggatcctctcctgtttctctctcttgcctccccctt

SEQ ID NO: 419957 - DNA, 373 bp, Homo sapiens
ctgccccctccatgttctgtttacatgtaaattgagccaccaactctttctctgtagcagtccggagtaacactggccagaagactcagcctgatgtcatgtcacagaatgctagaaagctgatccagaaaaatcttgctacatcagctgatactccaccaagcaccgttccaggaactggcaagagtgttgcttgtagtcctaaaaaggcagtcagagaccctaaaactgggaaagctgaaacaaacatctgatccggacatttggcatgattctgtttgtatcaaacgatgaaaaatcggccgggcgcggtggctactgcactacagcctgggcaacagagccaggctgtgtctcaagaaaaaaagaaaaa

SEQ ID NO: 419958 - DNA, 367 bp, Homo sapiens
ttatgtccatgtgccttcatgcccaagaagctacattttgataaagtaaaacattcagtcttaaaacacctgatttctgttcgcagtttagagtgcagatagctgcctctcacagacactcatggagtgtcccccttcaggaagggatgaaagccctcgatatgaattcatgtcgagccccttcatgcctggcataaatatagtttttaatgttgaattcattcatatgtaggtatgcttcctgtatttatttctaaagtagtttctctttccttgatgccttattgatgtgataaacagcttggggaataaatctgtctttattttggaaatggtttttagaagcctagttttggccttaattact

SEQ ID NO: 419959 - DNA, 3801 bp, Homo sapiens
  misc_feature (3540)..(3540): n is a, c, g, or t
atgaatgaaatgttgtctcttccctccagtgttgtacatagtctagtaagtaagaaaactaagcctccagaaaaggctattacttcatcattacaaacagtaaataatttaattttagaatttacttttactttgaatttttatttgatggtggaaacaaagttcctataaaaatggagttgaactaagcagtttaaacacactcatatttgaaacatttgttacttaatcactaggtgactgtcttgagagtaattactgatactaaaactatttttcttaatcattaatttatcaattctaggatgaagaagctgctctggcagatggtgaagatgttccctatgagaacagtgttaggcagtttttgggtgaatataaatcatggcaagacaacattcaaacagttctatttacattagtccaggctatgggtcaggttcgaagtcaagaacacgttgaaatgctccaggaaatcactcccaccttgaaagaactgaaaacacaaagtcagagtatctataataatttagtgagttttgcatcacccttagtcaccgatgcaacaaatgaatgttcgagtccaacgtcatctgctacttatcagccatccttcgctgcagcagtccggagtaacactggccagaagactcagcctgatgtcatgtcacagaatgctagaaagctgatccagaaaaatcttgctacatcagctgatactccaccaagcaccgttccaggaactggcaagagtgttgcttgtagtcctaaaaaggcagtcagagaccctaaaactgggaaagcggtgcaagagagaaactcctatgcagtgagtgtgtggaagagagtgaaagccaagttagagggccgagatgttgatccgaataggaggatgtcagttgctgaacaggttgactatgtcattaaggaagcaactaatctagataacttggctcagctgtatgaaggttggacagcctgggtgtgaatggcaagacagtagatgagtctggttaagcgaggtcagacatccaccagaatcaactcagcctcaggcatccaaagccacaccacagtcggtggtgatgcaactgggggcttactctgaggaaacctaggaaatctcggtgcactaggaagtgaatcccgcaggacagctgcactcagggatacgcccaacaccatggcctgcaaccccagggtcaagggtgaaggaaagcaagctcaccgcctgaacacggagattgtctttctgccacagaacagcagcagacgtgtcgggaggttagctgcggaaagaaatcgggatgccgcggagcacagagtgatttggaactccattccacctgaccctgtgtgtacaatccaggaaaaaaacaaaccccactcagaaacagagaaaactggggtcgcgaagaaatcacagccaaggaagatttgatgcattcagattctcgtgtaacacttgttgcttggcaacagtactggttgggttgaccagtaagtagaaaaaggctaaaggctatgcgatatgaatttcagaaatggactgaaaatggagagctatgtaacagatacactacagtagaagaacttacttctgaaatgaagggaaaaaaaccaccccatcgttccctactcctccccaccacttacccgttccccctttacctaatctagtagattagccatctttcaaattcacttttatttcagtccttatatttcatatacttccgtctcgatgctgttaacaacttctgataacatggaaaattcaaggattgtttaaaggtctgatgatcacacacaaaatgtaattccggttatttaagtcatttctgtgattctatcatgtacagtttccagaattgtcactgtgcattcaaaagtaatgaatctaacagacatttgatttaatgtacactcccttttgcttatagtgtgcattttttttggaggtcattcaaattttccctcttctgtgatagctgtagtttctttcatagaaagtagctaatccagtgtaatcttttacctttttaaaaaccaagatagagtatctattagagttttacattgttgatgatagattaacaataaagtgatgttctggtggaggtagactgaaatttttttaattcatgtttttcatttgatacttttaatttacacttagtaaattaaaagttgtttaatttacttggcattttaggacatgtacatgaaacagtgaaaatgagatccaccaacatcttttattaagttcagttattagtctgtgaagtgctttactttttgcacaattttaatagcttgctattcagtaatacattatagtgaattcatgatcaaggtttccttaaatttagcattgcatttcagtactgactgtgtaagctaaattgctgatccaaaataaaaacccagactagaatagggttcttaaaatcaagtatcaatacaaaatagaacacaattaaaatcttaattgttggctgggcacagtggctcacgcctgtaatcccagcactttgggaggccgaggcgggcggatcatgaggttaggagagcgagaccatcctggctaacacggtgaaaccccgtctttactaaaaatacaaaaaaaattagccgggcgtggtggcgggcgcctgtagtcccagctactcgggaggctgaggcaggagaatggcgtgaacccaggaggcggagcttgcagtgagccgagattgtgccactgcactccagcctgggcaacagagctagactctgtgtcaaaaataaatgactagataaaaaaaaaaattgtttgagtacattttccctgcattttagagattaggacagtggtcactttctagttgccgtcttcacagacaaacttgaaaggtattaaggaaaaaattccacatagctctgggcctttttggtattctgattgccacgttaatctgtaatcgttaagtacccatgaaagaatgtgtttcagtatcagtgctttttgggtactttaacaagtattgtaggcacggtggatttttttgaaatacccatgtgtccaatagcaagttaaggaacctagcgcatcaaatttggttttcttcattcatttggaaccttattttcgcaaaaaacctagctggaataataatgccatattgtattttgcacactgctttattttctagaggctctgggagcaaattacattcatcacattacctctgctctctcaagattaaagtctttcagcaacattctttattgtcatcataaggaaaaacttttatcgcaatgatagtcagttcacattagtttagcactatagatagtattcagaaattgctttctctttggtaaagaagataaataggtgaattttattgcctgttttttcaggcttcagaggtacctggcaccttactcaagcaaaaacaaaaaacagctttacttcaaaagcatgtgcctctggtaaattatccatcacttttgttttaaagtggtccctccaagaataatgtggcatacacagtgggntttggttgtaacggcagatgtaatagatgacttcaaaagcctgctccttactgcactctggacgaggccctggtctgtatagtttggcttcctctgttaagtcattctacaaggtgacttgccatttgaactttcgtaagagacctcagcagttagactgagaaaagttagagtgctgtagttatgaagtcatacatttttgataaaatacctgtggaaaaccagggatcctctcctgtttctctctcttgcctccccctt

SEQ ID NO: 419960 - DNA, 7235 bp, Homo sapiens
  misc_feature (1)..(1): n is a, c, g, or t
  misc_feature (3)..(5): n is a, c, g, or t
  misc_feature (7)..(7): n is a, c, g, or t
  misc_feature (9)..(9): n is a, c, g, or t
  misc_feature (46)..(46): n is a, c, g, or t
  misc_feature (2574)..(2574): n is a, c, g, or t
  misc_feature (5466)..(5466): n is a, c, g, or t
  misc_feature (7157)..(7157): n is a, c, g, or t
ngnnnananagagtttcactctgttgcccaggctggagtgcagtgncgcaatctcggctcactgcagcctctgccctctgagttcaagtgattctcctgcctcagcctcctgagtagctgggattacaggtgtctgccaccgtgcccagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcatctgctttggagaacacagtttctaacagactttcaacagaggactgtcttattccactcttcagtgaagctttacgttcatgtaaacagcatgacgtgaggccatggatgcaggcattaaggtatactatgtaccagaatcagttgttggagaaaattaaagaacaaacagtcccaattagaagccatctcatggaattaggtctaacagcagcaaaatttgctagaaaacgagggaatgtgtcccttgcaacaagactgctggcacagtgcagtgaagttcagctgggaaagaccaccactgcacaggatttagtccaacattttaaaaaactatcaacccaaggtcaagtggatgaaaaatgggggcccgaacttgatattgaaaaaaccaaattgctttatacagcaggccagtcaacacatgcaatggaaatgttgagttcttgtgccatatctttctgcaagtctgtgaaagctgaatatgcagttgctaaatcaattctgacactggctaaatggatccaggcagaatggaaagagatttcaggacagctgaaacaggtttacagagctcagcaccaacagaacttcacaggtctttctactttgtctaaaaacatactcactctaatagaactgccatctgttaatacgatggaagaagagtatcctcggatcgagagtgaatctacagtgcatattggagttggagaacctgacttcattttgggacagttgtatcacctgtcttcagtacaggcacctgaagtagccaaatcttgggcagcgttggccagctgggcttataggtggggcagaaaggtggttgacaatgccagtcagggagaaggtgttcgtctgctgcctagagaaaaatctgaagttcagaatctacttccagacactataactgaggaagagaaagagagaatatatggtattcttggacaggctgtgtgtcggccggcggggattcaggatgaagatataacacttcagataactgagagtgaagacaacgaagaagatgacatggttgatgttatctggcgtcagttgatatcaagctgcccatggctttcagaacttgatgaaagtgcaactgaaggagttattaaagtgtggaggaaagttgtagatagaatattcagcctgtacaaactctcttgcagtgcatactttactttccttaaactcaacgctggtcaaattcctttagatgaggatgaccctaggctgcatttaagtcacagagtggaacagagcactgatgacatgattgtgatggccacattgcgcctgctgcggttgctcgtgaagcacgctggtgagcttcggcagtatctggagcacggcttggagacaacacccactgcaccatggagaggaattattccgcaacttttctcacgcttaaaccaccctgaagtgtatgtgcgccaaagtatttgtaaccttctctgccgtgtggctcaagattccccacatctcatattgtatcctgcaatagtgggtaccatatcgcttagtagtgaatcccaggcttcaggaaataaattttccactgcaattccaactttacttggcaatattcaaggagaagaattgctggtttctgaatgtgagggaggaagtcctcctgcatctcaggatagcaataaggatgaacctaaaagtggattaaatgaagaccaagccatgatgcaggattgttacagcaaaattgtagataagctgtcctctgcaaaccccaccatggtattacaggttcagatgctcgtggctgaactgcgcagggtcactgtgctctgggatgagctctggctgggagttttgctgcaacaacacatgtatgtcctgagacgaattcagcagcttgaagatgaggtgaagagagtccagaacaacaacaccttacgcaaagaagagaaaattgcaatcatgagggagaagcacacagctttgatgaagcccatcgtatttgctttggagcatgtgaggagtatcacagcggctcctgcagaaacacctcatgaaaaatggtttcaggataactatggtgatgccattgaaaatgccctagaaaaactgaagactccattgaaccctgcaaagcctgggagcagctggattccatttaaagagataatgctaantttgcaacagagagcacagaaacgtgcaagttacatcttgcgtcttgaagaaatcagtccatggttggctgccatgactaacactgaaattgctcttcctggggaagtctcagccagagacactgtcacaatccatagtgtgggcggaaccatcacaatcttaccgactaaaaccaagccaaagaaacttctctttcttggatcagatgggaagagctatccttatcttttcaaaggactggaggatttacatctggatgagagaataatgcagttcctatctattgtgaataccatgtttgctacaattaatcgccaagaaacaccccggttccatgctcgacactattctgtaacaccactaggaacaagatcaggactaatccagtgggtagatggagccacacccttatttggtctttacaaacgatggcaacaacgggaagctgccttacaagcacaaaaggcccaagattcctaccaaactcctcagaatcctggaattgtaccccgtcctagtgaactttattacagtaaaattggccctgctttgaaaacagttgggcttagcctggatgtgtcccgtcgggattggcctcttcatgtaatgaaggcagtattggaagagttaatggaggccacacccccgaatctccttgccaaagagctctggtcatcttgcacaacacctgatgaatggtggagagttacgcagtcttatgcaagatctactgcagtcatgtctatggttggatacataattggccttggagacagacatctggataatgttcttatagatatgacgactggagaagttgttcacatagattacaatgtttgctttgaaaaaggtaaaagccttagagttcctgagaaagtaccttttcgaatgacacaaaacattgaaacagcactgggtgtaactggagtagaaggtgtatttaggctttcatgtgagcaggttttacacattatgcggcgtggcagagagaccctgctgacgctgctggaggcctttgtgtacgaccctctggtggactggacagcaggaggcgaggctgggtttgctggtgctgtctatggtggaggtggccagcaggccgagagcaagcagagcaagagagagatggagcgagagatcacccgcagcctgttttcttctagagtagctgagattaaggtgaactggtttaagaatagagatgagatgctggttgtgcttcccaagttggacggtagcttagatgaatacctaagcttgcaagagcaactgacagatgtggaaaaactgcagggcaaactactggaggaaatagagtttctagaaggagctgaaggggtggatcatccttctcatactctgcaacacaggtattctgagcacacccaactacagactcagcaaagagctgttcaggaagcaatccaggtgaagctgaatgaatttgaacaatggataacacattatcaggctgcattcaataatttagaagcaacacagcttgcaagcttgcttcaagagataagcacacaaatggaccttggtcctccaagttacgtgccagcaacagcctttctgcagaatgctggtcaggcccacttgattagccagtgcgagcagctggagggggaggttggtgctctcctgcagcagaggcgctccgtgctccgtggctgtctggagcaactgcatcactatgcaaccgtggccctgcagtatccgaaggccatatttcagaaacatcgaattgaacagtggaagacctggatggaagagctcatctgtaacaccacagtagagcgttgtcaagagctctataggaaatatgaaatgcaatatgctccccagccacccccaacagtgtgtcagttcatcactgccactgaaatgaccctgcagcgatacgcagcagacatcaacagcagacttattagacaagtggaacgcttgaaacaggaagctgtcactgtgccagtttgtgaagatcagttgaaagaaattgaacgttgcattaaagttttccttcatgagaatggagaagaaggatctttgagtctagcaagtgttattatttctgccctttgtacccttacaaggcgtaacctgatgatggaaggtgcagcgtcaagtgctggagaacagctggttgatctgacttctcgggatggagcctggttcttggaggaactctgcagtatgagcggaaacgtcacctgcttggttcagttactgaagcagtgccacctggtgccacaggacttagatatcccgaaccccatggaagcgtctgagacagttcacttagccaatggagtgtatacctcacttcaggaattgaattcgaatttccggcaaatcatatttccagaagcacttcgatgtttaatgaaaggggaatacacgttagaaagtatgctgcatgaactggacggtcttattgagcagaccaccgatggcgttcccctgcagactctagtggaatctcttcaggcctacttaagaaacgcagctatgggactggaagaagaaacacatgctcattacatcgatgttgccagactactacatgctcagtacggtgaattaatccaaccgagaaatggttcagttgatgaaacacccaaaatgtcagctggccagatgcttttggtagcattcgatggcatgtttgctcaagttgaaactgctttcagcttattagttgaaaagttgaacaagatggaaattcccatagcttggcgaaagattgacatcataagggaagccaggagtactcaagttaatttttttgatgatgataatcaccggcaggtgctagaagagattttctttctaaaaagactacagactattaaggagttcttcaggctctgtggtaccttttctanaacattgtcaggatcaagttcacttgaagatcagaatactgtgaatgggcctgtacagattgtcaatgtgaaaaccctttttagaaactcttgtttcagtgaagaccaaatggccaaacctatcaaggcattcacagctgactttgtgaggcagctcttgatagggctacccaaccaagccctcggactcacactgtgcagttttatcagtgctctgggtgtagacatcattgctcaagtagaggcaaaggactttggtgccgaaagcaaagtttctgttgatgatctctgtaagaaagcggtggaacataacatccagatagggaagttctctcagctggttatgaacagggcaactgtgttagcaagttcttacgacactgcctggaagaagcatgacttggtgcgaaggctagaaaccagtatttcttcttgtaagacaagcctgcagcgggttcagctgcatattgccatgtttcagtggcaacatgaagatctacttatcaatagaccacaagccatgtcagtcacacctcccccacggtctgctatcctaaccagcatgaaaaagaagctgcataccctgagccagattgaaacttctattgcgacagttcaggagaagctagctgcacttgaatcaagtattgaacagcgactcaagtgggcaggtggtgccaaccctgcattggcccctgtactacaagattttgaagcaacgatagctgaaagaagaaatcttgtccttaaagagagccaaagagcaagtcaggtcacatttctctgcagcaatatcattcattttgaaagtttacgaacaagaactgcagaagccttaaacctggatgcggcgttatttgaactaatcaagcgatgtcagcagatgtgttcgtttgcatcacagtttaacagttcagtgtctgagttagagcttcgtttattacagagagtggacactggtcttgaacatcctattggcagctctgaatggcttttgtcagcacacaaacagttgacccaggatatgtctactcagagggcaattcagacagagaaagagcagcagatagaaacggtctgtgaaacaattcagaatctggttgataatataaagactgtgctcactggtcataaccgacagcttggagatgtcaaacatctcttgaaagctatggctaaggatgaagaagctgctctggcagatggtgaagatgttccctatgagaacagtgttaggcagtttttgggtgaatataaatcatggcaagacaacattcaaacagttctatttacattagtccaggctatgggtcaggttcgaagtcaagaacacgttgaaatgctccaggaaatcactcccaccttgaaagaactgaaaacacaaagtcagagtatctataataatttagtgagttttgcatcacccttagtcaccgatgcaacaaatgaatgttcgagtccaacgtcatctgctacttatcagccatccttcgctgcagcagtccggagtaacactggccagaagactcagcctgatgtcatgtcacagaatgctagaaagctgatccagaaaaatcttgctacatcagctgatactccaccaagcaccgttccaggaactggcaagagtgttgcttgtagtcctaaaaaggcagtcagagaccctaaaactgggaaagccgtgaacgaangaaactcctattccgggagttggtggatagtttacagggttgcttatcactaatagaagaactaattatatacttgga

SEQ ID NO: 419961 - DNA, 7404 bp, Homo sapiens
  misc_feature (1)..(1): n is a, c, g, or t
  misc_feature (3)..(5): n is a, c, g, or t
  misc_feature (7)..(7): n is a, c, g, or t
  misc_feature (9)..(9): n is a, c, g, or t
  misc_feature (46)..(46): n is a, c, g, or t
  misc_feature (2574)..(2574): n is a, c, g, or t
  misc_feature (5466)..(5466): n is a, c, g, or t
ngnnnananagagtttcactctgttgcccaggctggagtgcagtgncgcaatctcggctcactgcagcctctgccctctgagttcaagtgattctcctgcctcagcctcctgagtagctgggattacaggtgtctgccaccgtgcccagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcatctgctttggagaacacagtttctaacagactttcaacagaggactgtcttattccactcttcagtgaagctttacgttcatgtaaacagcatgacgtgaggccatggatgcaggcattaaggtatactatgtaccagaatcagttgttggagaaaattaaagaacaaacagtcccaattagaagccatctcatggaattaggtctaacagcagcaaaatttgctagaaaacgagggaatgtgtcccttgcaacaagactgctggcacagtgcagtgaagttcagctgggaaagaccaccactgcacaggatttagtccaacattttaaaaaactatcaacccaaggtcaagtggatgaaaaatgggggcccgaacttgatattgaaaaaaccaaattgctttatacagcaggccagtcaacacatgcaatggaaatgttgagttcttgtgccatatctttctgcaagtctgtgaaagctgaatatgcagttgctaaatcaattctgacactggctaaatggatccaggcagaatggaaagagatttcaggacagctgaaacaggtttacagagctcagcaccaacagaacttcacaggtctttctactttgtctaaaaacatactcactctaatagaactgccatctgttaatacgatggaagaagagtatcctcggatcgagagtgaatctacagtgcatattggagttggagaacctgacttcattttgggacagttgtatcacctgtcttcagtacaggcacctgaagtagccaaatcttgggcagcgttggccagctgggcttataggtggggcagaaaggtggttgacaatgccagtcagggagaaggtgttcgtctgctgcctagagaaaaatctgaagttcagaatctacttccagacactataactgaggaagagaaagagagaatatatggtattcttggacaggctgtgtgtcggccggcggggattcaggatgaagatataacacttcagataactgagagtgaagacaacgaagaagatgacatggttgatgttatctggcgtcagttgatatcaagctgcccatggctttcagaacttgatgaaagtgcaactgaaggagttattaaagtgtggaggaaagttgtagatagaatattcagcctgtacaaactctcttgcagtgcatactttactttccttaaactcaacgctggtcaaattcctttagatgaggatgaccctaggctgcatttaagtcacagagtggaacagagcactgatgacatgattgtgatggccacattgcgcctgctgcggttgctcgtgaagcacgctggtgagcttcggcagtatctggagcacggcttggagacaacacccactgcaccatggagaggaattattccgcaacttttctcacgcttaaaccaccctgaagtgtatgtgcgccaaagtatttgtaaccttctctgccgtgtggctcaagattccccacatctcatattgtatcctgcaatagtgggtaccatatcgcttagtagtgaatcccaggcttcaggaaataaattttccactgcaattccaactttacttggcaatattcaaggagaagaattgctggtttctgaatgtgagggaggaagtcctcctgcatctcaggatagcaataaggatgaacctaaaagtggattaaatgaagaccaagccatgatgcaggattgttacagcaaaattgtagataagctgtcctctgcaaaccccaccatggtattacaggttcagatgctcgtggctgaactgcgcagggtcactgtgctctgggatgagctctggctgggagttttgctgcaacaacacatgtatgtcctgagacgaattcagcagcttgaagatgaggtgaagagagtccagaacaacaacaccttacgcaaagaagagaaaattgcaatcatgagggagaagcacacagctttgatgaagcccatcgtatttgctttggagcatgtgaggagtatcacagcggctcctgcagaaacacctcatgaaaaatggtttcaggataactatggtgatgccattgaaaatgccctagaaaaactgaagactccattgaaccctgcaaagcctgggagcagctggattccatttaaagagataatgctaantttgcaacagagagcacagaaacgtgcaagttacatcttgcgtcttgaagaaatcagtccatggttggctgccatgactaacactgaaattgctcttcctggggaagtctcagccagagacactgtcacaatccatagtgtgggcggaaccatcacaatcttaccgactaaaaccaagccaaagaaacttctctttcttggatcagatgggaagagctatccttatcttttcaaaggactggaggatttacatctggatgagagaataatgcagttcctatctattgtgaataccatgtttgctacaattaatcgccaagaaacaccccggttccatgctcgacactattctgtaacaccactaggaacaagatcaggactaatccagtgggtagatggagccacacccttatttggtctttacaaacgatggcaacaacgggaagctgccttacaagcacaaaaggcccaagattcctaccaaactcctcagaatcctggaattgtaccccgtcctagtgaactttattacagtaaaattggccctgctttgaaaacagttgggcttagcctggatgtgtcccgtcgggattggcctcttcatgtaatgaaggcagtattggaagagttaatggaggccacacccccgaatctccttgccaaagagctctggtcatcttgcacaacacctgatgaatggtggagagttacgcagtcttatgcaagatctactgcagtcatgtctatggttggatacataattggccttggagacagacatctggataatgttcttatagatatgacgactggagaagttgttcacatagattacaatgtttgctttgaaaaaggtaaaagccttagagttcctgagaaagtaccttttcgaatgacacaaaacattgaaacagcactgggtgtaactggagtagaaggtgtatttaggctttcatgtgagcaggttttacacattatgcggcgtggcagagagaccctgctgacgctgctggaggcctttgtgtacgaccctctggtggactggacagcaggaggcgaggctgggtttgctggtgctgtctatggtggaggtggccagcaggccgagagcaagcagagcaagagagagatggagcgagagatcacccgcagcctgttttcttctagagtagctgagattaaggtgaactggtttaagaatagagatgagatgctggttgtgcttcccaagttggacggtagcttagatgaatacctaagcttgcaagagcaactgacagatgtggaaaaactgcagggcaaactactggaggaaatagagtttctagaaggagctgaaggggtggatcatccttctcatactctgcaacacaggtattctgagcacacccaactacagactcagcaaagagctgttcaggaagcaatccaggtgaagctgaatgaatttgaacaatggataacacattatcaggctgcattcaataatttagaagcaacacagcttgcaagcttgcttcaagagataagcacacaaatggaccttggtcctccaagttacgtgccagcaacagcctttctgcagaatgctggtcaggcccacttgattagccagtgcgagcagctggagggggaggttggtgctctcctgcagcagaggcgctccgtgctccgtggctgtctggagcaactgcatcactatgcaaccgtggccctgcagtatccgaaggccatatttcagaaacatcgaattgaacagtggaagacctggatggaagagctcatctgtaacaccacagtagagcgttgtcaagagctctataggaaatatgaaatgcaatatgctccccagccacccccaacagtgtgtcagttcatcactgccactgaaatgaccctgcagcgatacgcagcagacatcaacagcagacttattagacaagtggaacgcttgaaacaggaagctgtcactgtgccagtttgtgaagatcagttgaaagaaattgaacgttgcattaaagttttccttcatgagaatggagaagaaggatctttgagtctagcaagtgttattatttctgccctttgtacccttacaaggcgtaacctgatgatggaaggtgcagcgtcaagtgctggagaacagctggttgatctgacttctcgggatggagcctggttcttggaggaactctgcagtatgagcggaaacgtcacctgcttggttcagttactgaagcagtgccacctggtgccacaggacttagatatcccgaaccccatggaagcgtctgagacagttcacttagccaatggagtgtatacctcacttcaggaattgaattcgaatttccggcaaatcatatttccagaagcacttcgatgtttaatgaaaggggaatacacgttagaaagtatgctgcatgaactggacggtcttattgagcagaccaccgatggcgttcccctgcagactctagtggaatctcttcaggcctacttaagaaacgcagctatgggactggaagaagaaacacatgctcattacatcgatgttgccagactactacatgctcagtacggtgaattaatccaaccgagaaatggttcagttgatgaaacacccaaaatgtcagctggccagatgcttttggtagcattcgatggcatgtttgctcaagttgaaactgctttcagcttattagttgaaaagttgaacaagatggaaattcccatagcttggcgaaagattgacatcataagggaagccaggagtactcaagttaatttttttgatgatgataatcaccggcaggtgctagaagagattttctttctaaaaagactacagactattaaggagttcttcaggctctgtggtaccttttctanaacattgtcaggatcaagttcacttgaagatcagaatactgtgaatgggcctgtacagattgtcaatgtgaaaaccctttttagaaactcttgtttcagtgaagaccaaatggccaaacctatcaaggcattcacagctgactttgtgaggcagctcttgatagggctacccaaccaagccctcggactcacactgtgcagttttatcagtgctctgggtgtagacatcattgctcaagtagaggcaaaggactttggtgccgaaagcaaagtttctgttgatgatctctgtaagaaagcggtggaacataacatccagatagggaagttctctcagctggttatgaacagggcaactgtgttagcaagttcttacgacactgcctggaagaagcatgacttggtgcgaaggctagaaaccagtatttcttcttgtaagacaagcctgcagcgggttcagctgcatattgccatgtttcagtggcaacatgaagatctacttatcaatagaccacaagccatgtcagtcacacctcccccacggtctgctatcctaaccagcatgaaaaagaagctgcataccctgagccagattgaaacttctattgcgacagttcaggagaagctagctgcacttgaatcaagtattgaacagcgactcaagtgggcaggtggtgccaaccctgcattggcccctgtactacaagattttgaagcaacgatagctgaaagaagaaatcttgtccttaaagagagccaaagagcaagtcaggtcacatttctctgcagcaatatcattcattttgaaagtttacgaacaagaactgcagaagccttaaacctggatgcggcgttatttgaactaatcaagcgatgtcagcagatgtgttcgtttgcatcacagtttaacagttcagtgtctgagttagagcttcgtttattacagagagtggacactggtcttgaacatcctattggcagctctgaatggcttttgtcagcacacaaacagttgacccaggatatgtctactcagagggcaattcagacagagaaagagcagcagatagaaacggtctgtgaaacaattcagaatctggttgataatataaagactgtgctcactggtcataaccgacagcttggagatgtcaaacatctcttgaaagctatggctaaggatgaagaagctgctctggcagatggtgaagatgttccctatgagaacagtgttaggcagtttttgggtgaatataaatcatggcaagacaacattcaaacagttctatttacattagtccaggctatgggtcaggttcgaagtcaagaacacgttgaaatgctccaggaaatcactcccaccttgaaagaactgaaaacacaaagtcagaggtaagaatgccttctggtcagaatttataaaacataagtacaaaactactggtataagaagtttatctcttgatttaatttttcagttttgttcatatttttataagtagtatcaggtaaaacatttcgtaaataagccattttattttgtatttcagtatctataataatttagtgagttttgcatcacccttagtcaccgatgcaacaaatgaatgttcgagtccaacgtcatctgctacttatcagccatccttcgctgcaggtaggagaagagtcctgagtcttgatctgttgttaatgttacacatagatgctaagatgtttaattatacataactgtctaatattaaacacttaaggcctgtcattctataatcttaaactgaacagattttagcttatccttaaaaatactcgtaagccaggcacgatggctcacacctgtaatctcagctacttgaaggccaaggtgggaggattgtctaaggccaggagttcaagaccctgtctctttaaaaataaataaataaacagctattaaaa

SEQ ID NO: 419962 - DNA, 2946 bp, Homo sapiens
  misc_feature (51)..(51): n is a, c, g, or t
  misc_feature (2685)..(2685): n is a, c, g, or t
gttttggaaccttaaagcctgcattgacttctcttaatttacccaccggcnacaggttgactatgtcattaaggaagcaactaatctagataacttggctcagctgtatgaaggttggacagcctgggtgtgaatggcaagacagtagatgagtctggttaagcgaggtcagacatccaccagaatcaactcagcctcaggcatccaaagccacaccacagtcggtggtgatgcaactgggggcttactctgaggaaacctaggaaatctcggtgcactaggaagtgaatcccgcaggacagctgcactcagggatacgcccaacaccatggcctgcaaccccagggtcaagggtgaaggaaagcaagctcaccgcctgaacacggagattgtctttctgccacagaacagcagcagacgtgtcgggaggttagctgcggaaagaaatcgggatgccgcggagcacagagtgatttggaactccattccacctgaccctgtgtgtacaatccaggaaaaaaacaaaccccactcagaaacagagaaaactggggtcgcgaagaaatcacagccaaggaagatttgatgcattcagattctcgtgtaacacttgttgcttggcaacagtactggttgggttgaccagtaagtagaaaaaggctaaaggctatgcgatatgaatttcagaaatggactgaaaatggagagctatgtaacagatacactacagtagaagaacttacttctgaaatgaagggaaaaaaaccaccccatcgttccctactcctccccaccacttacccgttccccctttacctaatctagtagattagccatctttcaaattcacttttatttcagtccttatatttcatatacttccgtctcgatgctgttaacaacttctgataacatggaaaattcaaggattgtttaaaggtctgatgatcacacacaaaatgtaattccggttatttaagtcatttctgtgattctatcatgtacagtttccagaattgtcactgtgcattcaaaagtaatgaatctaacagacatttgatttaatgtacactcccttttgcttatagtgtgcattttttttggaggtcattcaaattttccctcttctgtgatagctgtagtttctttcatagaaagtagctaatccagtgtaatcttttacctttttaaaaaccaagatagagtatctattagagttttacattgttgatgatagattaacaataaagtgatgttctggtggaggtagactgaaatttttttaattcatgtttttcatttgatacttttaatttacacttagtaaattaaaagttgtttaatttacttggcattttaggacatgtacatgaaacagtgaaaatgagatccaccaacatcttttattaagttcagttattagtctgtgaagtgctttactttttgcacaattttaatagcttgctattcagtaatacattatagtgaattcatgatcaaggtttccttaaatttagcattgcatttcagtactgactgtgtaagctaaattgctgatccaaaataaaaacccagactagaatagggttcttaaaatcaagtatcaatacaaaatagaacacaattaaaatcttaattgttggctgggcacagtggctcacgcctgtaatcccagcactttgggaggccgaggcgggcggatcatgaggttaggagagcgagaccatcctggctaacacggtgaaaccccgtctttactaaaaatacaaaaaaaattagccgggcgtggtggcgggcgcctgtagtcccagctactcgggaggctgaggcaggagaatggcgtgaacccaggaggcggagcttgcagtgagccgagattgtgccactgcactccagcctgggcaacagagctagactctgtgtcaaaaataaatgactagataaaaaaaaaaattgtttgagtacattttccctgcattttagagattaggacagtggtcactttctagttgccgtcttcacagacaaacttgaaaggtattaaggaaaaaattccacatagctctgggcctttttggtattctgattgccacgttaatctgtaatcgttaagtacccatgaaagaatgtgtttcagtatcagtgctttttgggtactttaacaagtattgtaggcacggtggatttttttgaaatacccatgtgtccaatagcaagttaaggaacctagcgcatcaaatttggttttcttcattcatttggaaccttattttcgcaaaaaacctagctggaataataatgccatattgtattttgcacactgctttattttctagaggctctgggagcaaattacattcatcacattacctctgctctctcaagattaaagtctttcagcaacattctttattgtcatcataaggaaaaacttttatcgcaatgatagtcagttcacattagtttagcactatagatagtattcagaaattgctttctctttggtaaagaagataaataggtgaattttattgcctgttttttcaggcttcagaggtacctggcaccttactcaagcaaaaacaaaaaacagctttacttcaaaagcatgtgcctctggtaaattatccatcacttttgttttaaagtggtccctccaagaataatgtggcatacacagtgggntttggttgtaacggcagatgtaatagatgacttcaaaagcctgctccttactgcactctggacgaggccctggtctgtatagtttggcttcctctgttaagtcattctacaaggtgacttgccatttgaactttcgtaagagacctcagcagttagactgagaaaagttagagtgctgtagttatgaagtcatacatttttgataaaatacctgtggaaaaccagggatcctctcctgtttctctctcttgcctccccctt

SEQ ID NO: 419963 - DNA, 3974 bp, Homo sapiens
  misc_feature (1)..(1): n is a, c, g, or t
  misc_feature (3)..(5): n is a, c, g, or t
  misc_feature (7)..(7): n is a, c, g, or t
  misc_feature (9)..(9): n is a, c, g, or t
  misc_feature (46)..(46): n is a, c, g, or t
  misc_feature (2574)..(2574): n is a, c, g, or t
ngnnnananagagtttcactctgttgcccaggctggagtgcagtgncgcaatctcggctcactgcagcctctgccctctgagttcaagtgattctcctgcctcagcctcctgagtagctgggattacaggtgtctgccaccgtgcccagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcatctgctttggagaacacagtttctaacagactttcaacagaggactgtcttattccactcttcagtgaagctttacgttcatgtaaacagcatgacgtgaggccatggatgcaggcattaaggtatactatgtaccagaatcagttgttggagaaaattaaagaacaaacagtcccaattagaagccatctcatggaattaggtctaacagcagcaaaatttgctagaaaacgagggaatgtgtcccttgcaacaagactgctggcacagtgcagtgaagttcagctgggaaagaccaccactgcacaggatttagtccaacattttaaaaaactatcaacccaaggtcaagtggatgaaaaatgggggcccgaacttgatattgaaaaaaccaaattgctttatacagcaggccagtcaacacatgcaatggaaatgttgagttcttgtgccatatctttctgcaagtctgtgaaagctgaatatgcagttgctaaatcaattctgacactggctaaatggatccaggcagaatggaaagagatttcaggacagctgaaacaggtttacagagctcagcaccaacagaacttcacaggtctttctactttgtctaaaaacatactcactctaatagaactgccatctgttaatacgatggaagaagagtatcctcggatcgagagtgaatctacagtgcatattggagttggagaacctgacttcattttgggacagttgtatcacctgtcttcagtacaggcacctgaagtagccaaatcttgggcagcgttggccagctgggcttataggtggggcagaaaggtggttgacaatgccagtcagggagaaggtgttcgtctgctgcctagagaaaaatctgaagttcagaatctacttccagacactataactgaggaagagaaagagagaatatatggtattcttggacaggctgtgtgtcggccggcggggattcaggatgaagatataacacttcagataactgagagtgaagacaacgaagaagatgacatggttgatgttatctggcgtcagttgatatcaagctgcccatggctttcagaacttgatgaaagtgcaactgaaggagttattaaagtgtggaggaaagttgtagatagaatattcagcctgtacaaactctcttgcagtgcatactttactttccttaaactcaacgctggtcaaattcctttagatgaggatgaccctaggctgcatttaagtcacagagtggaacagagcactgatgacatgattgtgatggccacattgcgcctgctgcggttgctcgtgaagcacgctggtgagcttcggcagtatctggagcacggcttggagacaacacccactgcaccatggagaggaattattccgcaacttttctcacgcttaaaccaccctgaagtgtatgtgcgccaaagtatttgtaaccttctctgccgtgtggctcaagattccccacatctcatattgtatcctgcaatagtgggtaccatatcgcttagtagtgaatcccaggcttcaggaaataaattttccactgcaattccaactttacttggcaatattcaaggagaagaattgctggtttctgaatgtgagggaggaagtcctcctgcatctcaggatagcaataaggatgaacctaaaagtggattaaatgaagaccaagccatgatgcaggattgttacagcaaaattgtagataagctgtcctctgcaaaccccaccatggtattacaggttcagatgctcgtggctgaactgcgcagggtcactgtgctctgggatgagctctggctgggagttttgctgcaacaacacatgtatgtcctgagacgaattcagcagcttgaagatgaggtgaagagagtccagaacaacaacaccttacgcaaagaagagaaaattgcaatcatgagggagaagcacacagctttgatgaagcccatcgtatttgctttggagcatgtgaggagtatcacagcggctcctgcagaaacacctcatgaaaaatggtttcaggataactatggtgatgccattgaaaatgccctagaaaaactgaagactccattgaaccctgcaaagcctgggagcagctggattccatttaaagagataatgctaantttgcaacagagagcacagaaacgtgcaagttacatcttgcgtcttgaagaaatcagtccatggttggctgccatgactaacactgaaattgctcttcctggggaagtctcagccagagacactgtcacaatccatagtgtgggcggaaccatcacaatcttaccgactaaaaccaagccaaagaaacttctctttcttggatcagatgggaagagctatccttatcttttcaaaggactggaggatttacatctggatgagagaataatgcagttcctatctattgtgaataccatgtttgctacaattaatcgccaagaaacaccccggttccatgctcgacactattctgtaacaccactaggaacaagatcaggactaatccagtgggtagatggagccacacccttatttggtctttacaaacgatggcaacaacgggaagctgccttacaagcacaaaaggcccaagattcctaccaaactcctcagaatcctggaattgtaccccgtcctagtgaactttattacagtaaaattggccctgctttgaaaacagttgggcttagcctggatgtgtcccgtcgggattggcctcttcatgtaatgaaggcagtattggaagagttaatggaggccacacccccgaatctccttgccaaagagctctggtcatcttgcacaacacctgatgaatggtggagagttacgcagtcttatgcaagatctactgcagtcatgtctatggttggatacataattggccttggagacagacatctggataatgttcttatagatatgacgactggagaagttgttcacatagattacaatgtttgctttgaaaaaggtaaaagccttagagttcctgagaaagtaccttttcgaatgacacaaaacattgaaacagcactgggtgtaactggagtagaaggtgtatttaggctttcatgtgagcaggttttacacattatgcggcgtggcagagagaccctgctgacgctgctggaggcctttgtgtacgaccctctggtggactggacagcaggaggcgaggctgggtttgctggtgctgtctatggtggaggtggccagcaggccgagagcaagcagagcaagagagagatggagcgagagatcacccgcagcctgttttcttctagagtagctgagattaaggtgaagcccagtgacggaataagtcattgtcttctttttattaatagagtaaacatgctcatcaaaatgttgaggcaaattgtttctctaatttttttggcaaaactaatgtataatattgaaatggcagttaaatatggcagtttgagaccagcctgcccaacattggtttgggcaacactgaaccccgtttcaaccaaaaatacaaacaaaacaa

SEQ ID NO: 419964 - DNA, 3119 bp, Homo sapiens
  misc_feature (1)..(1): n is a, c, g, or t
  misc_feature (3)..(5): n is a, c, g, or t
  misc_feature (7)..(7): n is a, c, g, or t
  misc_feature (9)..(9): n is a, c, g, or t
  misc_feature (46)..(46): n is a, c, g, or t
ngnnnananagagtttcactctgttgcccaggctggagtgcagtgncgcaatctcggctcactgcagcctctgccctctgagttcaagtgattctcctgcctcagcctcctgagtagctgggattacaggtgtctgccaccgtgcccagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcatctgctttggagaacacagtttctaacagactttcaacagaggactgtcttattccactcttcagtgaagctttacgttcatgtaaacagcatgacgtgaggccatggatgcaggcattaaggtatactatgtaccagaatcagttgttggagaaaattaaagaacaaacagtcccaattagaagccatctcatggaattaggtctaacagcagcaaaatttgctagaaaacgagggaatgtgtcccttgcaacaagactgctggcacagtgcagtgaagttcagctgggaaagaccaccactgcacaggatttagtccaacattttaaaaaactatcaacccaaggtcaagtggatgaaaaatgggggcccgaacttgatattgaaaaaaccaaattgctttatacagcaggccagtcaacacatgcaatggaaatgttgagttcttgtgccatatctttctgcaagtctgtgaaagctgaatatgcagttgctaaatcaattctgacactggctaaatggatccaggcagaatggaaagagatttcaggacagctgaaacaggtttacagagctcagcaccaacagaacttcacaggtctttctactttgtctaaaaacatactcactctaatagaactgccatctgttaatacgatggaagaagagtatcctcggatcgagagtgaatctacagtgcatattggagttggagaacctgacttcattttgggacagttgtatcacctgtcttcagtacaggcacctgaagtagccaaatcttgggcagcgttggccagctgggcttataggtggggcagaaaggtggttgacaatgccagtcagggagaaggtgttcgtctgctgcctagagaaaaatctgaagttcagaatctacttccagacactataactgaggaagagaaagagagaatatatggtattcttggacaggctgtgtgtcggccggcggggattcaggatgaagatataacacttcagataactgagagtgaagacaacgaagaagatgacatggttgatgttatctggcgtcagttgatatcaagctgcccatggctttcagaacttgatgaaagtgcaactgaaggagttattaaagtgtggaggaaagttgtagatagaatattcagcctgtacaaactctcttgcagtgcatactttactttccttaaactcaacgctggtcaaattcctttagatgaggatgaccctaggctgcatttaagtcacagagtggaacagagcactgatgacatgattgtgatggccacattgcgcctgctgcggttgctcgtgaagcacgctggtgagcttcggcagtatctggagcacggcttggagacaacacccactgcaccatggagaggaattattccgcaacttttctcacgcttaaaccaccctgaagtgtatgtgcgccaaagtatttgtaaccttctctgccgtgtggctcaagattccccacatctcatattgtatcctgcaatagtgggtaccatatcgcttagtagtgaatcccaggcttcaggaaataaattttccactgcaattccaactttacttggcaatattcaaggagaagaattgctggtttctgaatgtgagggaggaagtcctcctgcatctcaggatagcaataaggatgaacctaaaagtggattaaatgaagaccaagccatgatgcaggattgttacagcaaaattgtagataagctgtcctctgcaaaccccaccatggtattacaggttcagatgctcgtggctgaactgcgcagggtcactgtgctctgggatgagctctggctgggagttttgctgcaacaacacatgtatgtcctgagacgaattcagcagcttgaagatgaggtgaagagagtccagaacaacaacaccttacgcaaagaagagaaaattgcaatcatgagggagaagcacacagctttgatgaagcccatcgtatttgctttggagcatgtgaggagtatcacagcggctcctgcagaaacacctcatgaaaaatggtttcaggataactatggtgatgccattgaaaatgccctagaaaaactgaagactccattgaaccctgcaaagcctgggagcagctggattccatttaaagaggtacagaataatcccaagcatgctactgaaatggcacatcacagttcccatgagatacgaaatttcaataagtggacttcttacttggaatgtaagagattttataagcctataggaggcagcctgtggccagttgcttataaggaacatagaaaaaagtgtttctgtttaagaatttggaaatcagtgggcaaagggggatggacggcaaaggtgcccaatctttcatgtatggaaggctcacaccagtgaacaacagatgaagaaattagccaaggaaggggctgtgaccctgagctaaatattggttgcctgctttatttacctcattaaagataagaaatttaactttgtgcctatgtagtttttcacaaggagagcattcagtatttctaacagataaaatagtcgcttataacaacataaagttttacaagtagttctggaatcaattccacatatgctgcgtgggatgattagtgtattcacatatttgagaatccttatcttttatattttggttttcttaattctatattctcttaggtctttatct

SEQ ID NO: 419965 - DNA, 3074 bp, Homo sapiens
  misc_feature (1)..(1): n is a, c, g, or t
  misc_feature (3)..(5): n is a, c, g, or t
  misc_feature (7)..(7): n is a, c, g, or t
  misc_feature (9)..(9): n is a, c, g, or t
  misc_feature (46)..(46): n is a, c, g, or t
  misc_feature (2574)..(2574): n is a, c, g, or t
ngnnnananagagtttcactctgttgcccaggctggagtgcagtgncgcaatctcggctcactgcagcctctgccctctgagttcaagtgattctcctgcctcagcctcctgagtagctgggattacaggtgtctgccaccgtgcccagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcatctgctttggagaacacagtttctaacagactttcaacagaggactgtcttattccactcttcagtgaagctttacgttcatgtaaacagcatgacgtgaggccatggatgcaggcattaaggtatactatgtaccagaatcagttgttggagaaaattaaagaacaaacagtcccaattagaagccatctcatggaattaggtctaacagcagcaaaatttgctagaaaacgagggaatgtgtcccttgcaacaagactgctggcacagtgcagtgaagttcagctgggaaagaccaccactgcacaggatttagtccaacattttaaaaaactatcaacccaaggtcaagtggatgaaaaatgggggcccgaacttgatattgaaaaaaccaaattgctttatacagcaggccagtcaacacatgcaatggaaatgttgagttcttgtgccatatctttctgcaagtctgtgaaagctgaatatgcagttgctaaatcaattctgacactggctaaatggatccaggcagaatggaaagagatttcaggacagctgaaacaggtttacagagctcagcaccaacagaacttcacaggtctttctactttgtctaaaaacatactcactctaatagaactgccatctgttaatacgatggaagaagagtatcctcggatcgagagtgaatctacagtgcatattggagttggagaacctgacttcattttgggacagttgtatcacctgtcttcagtacaggcacctgaagtagccaaatcttgggcagcgttggccagctgggcttataggtggggcagaaaggtggttgacaatgccagtcagggagaaggtgttcgtctgctgcctagagaaaaatctgaagttcagaatctacttccagacactataactgaggaagagaaagagagaatatatggtattcttggacaggctgtgtgtcggccggcggggattcaggatgaagatataacacttcagataactgagagtgaagacaacgaagaagatgacatggttgatgttatctggcgtcagttgatatcaagctgcccatggctttcagaacttgatgaaagtgcaactgaaggagttattaaagtgtggaggaaagttgtagatagaatattcagcctgtacaaactctcttgcagtgcatactttactttccttaaactcaacgctggtcaaattcctttagatgaggatgaccctaggctgcatttaagtcacagagtggaacagagcactgatgacatgattgtgatggccacattgcgcctgctgcggttgctcgtgaagcacgctggtgagcttcggcagtatctggagcacggcttggagacaacacccactgcaccatggagaggaattattccgcaacttttctcacgcttaaaccaccctgaagtgtatgtgcgccaaagtatttgtaaccttctctgccgtgtggctcaagattccccacatctcatattgtatcctgcaatagtgggtaccatatcgcttagtagtgaatcccaggcttcaggaaataaattttccactgcaattccaactttacttggcaatattcaaggagaagaattgctggtttctgaatgtgagggaggaagtcctcctgcatctcaggatagcaataaggatgaacctaaaagtggattaaatgaagaccaagccatgatgcaggattgttacagcaaaattgtagataagctgtcctctgcaaaccccaccatggtattacaggttcagatgctcgtggctgaactgcgcagggtcactgtgctctgggatgagctctggctgggagttttgctgcaacaacacatgtatgtcctgagacgaattcagcagcttgaagatgaggtgaagagagtccagaacaacaacaccttacgcaaagaagagaaaattgcaatcatgagggagaagcacacagctttgatgaagcccatcgtatttgctttggagcatgtgaggagtatcacagcggctcctgcagaaacacctcatgaaaaatggtttcaggataactatggtgatgccattgaaaatgccctagaaaaactgaagactccattgaaccctgcaaagcctgggagcagctggattccatttaaagagataatgctaantttgcaacagagagcacagaaacgtgcaagttacatcttgcgtcttgaagaaatcagtccatggttggctgccatgactaacactgaaattgctcttcctggggaagtctcagccagagacactgtcacaatccatagtgtgggcggaaccatcacaatcttaccgactaaaaccaagccaaagaaacttctctttcttggatcagatgggaagagctatccttatcttttcaaaggactggaggatttacatctggatgagagaataatgcagttcctatctattgtgaataccatgtttgctacaattaatcgccaagaaacaccccggttccatgctcgacactattctgtaacaccactaggaacaagatcaggactaatccagtgggtagatggagccacacccttatttggtctttacaaacgatggcaacaacgggaagctgccttacaagcacaaaaggttgattaaatcatctacacagtgtattagtcta

SEQ ID NO: 419966 - DNA, 2263 bp, Homo sapiens
  misc_feature (1)..(1): n is a, c, g, or t
  misc_feature (3)..(5): n is a, c, g, or t
  misc_feature (7)..(7): n is a, c, g, or t
  misc_feature (9)..(9): n is a, c, g, or t
  misc_feature (46)..(46): n is a, c, g, or t
ngnnnananagagtttcactctgttgcccaggctggagtgcagtgncgcaatctcggctcactgcagcctctgccctctgagttcaagtgattctcctgcctcagcctcctgagtagctgggattacaggtgtctgccaccgtgcccagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcatctgctttggagaacacagtttctaacagactttcaacagaggactgtcttattccactcttcagtgaagctttacgttcatgtaaacagcatgacgtgaggccatggatgcaggcattaaggtatactatgtaccagaatcagttgttggagaaaattaaagaacaaacagtcccaattagaagccatctcatggaattaggtctaacagcagcaaaatttgctagaaaacgagggaatgtgtcccttgcaacaagactgctggcacagtgcagtgaagttcagctgggaaagaccaccactgcacaggatttagtccaacattttaaaaaactatcaacccaaggtcaagtggatgaaaaatgggggcccgaacttgatattgaaaaaaccaaattgctttatacagcaggccagtcaacacatgcaatggaaatgttgagttcttgtgccatatctttctgcaagtctgtgaaagctgaatatgcagttgctaaatcaattctgacactggctaaatggatccaggcagaatggaaagagatttcaggacagctgaaacaggtttacagagctcagcaccaacagaacttcacaggtctttctactttgtctaaaaacatactcactctaatagaactgccatctgttaatacgatggaagaagagtatcctcggatcgagagtgaatctacagtgcatattggagttggagaacctgacttcattttgggacagttgtatcacctgtcttcagtacaggcacctgaagtagccaaatcttgggcagcgttggccagctgggcttataggtggggcagaaaggtggttgacaatgccagtcagggagaaggtgttcgtctgctgcctagagaaaaatctgaagttcagaatctacttccagacactataactgaggaagagaaagagagaatatatggtattcttggacaggctgtgtgtcggccggcggggattcaggatgaagatataacacttcagataactgagagtgaagacaacgaagaagatgacatggttgatgttatctggcgtcagttgatatcaagctgcccatggctttcagaacttgatgaaagtgcaactgaaggagttattaaagtgtggaggaaagttgtagatagaatattcagcctgtacaaactctcttgcagtgcatactttactttccttaaactcaacgctggtcaaattcctttagatgaggatgaccctaggctgcatttaagtcacagagtggaacagagcactgatgacatgattgtgatggccacattgcgcctgctgcggttgctcgtgaagcacgctggtgagcttcggcagtatctggagcacggcttggagacaacacccactgcaccatggagaggaattattccgcaacttttctcacgcttaaaccaccctgaagtgtatgtgcgccaaagtatttgtaaccttctctgccgtgtggctcaagattccccacatctcatattgtatcctgcaatagtgggtaccatatcgcttagtagtgaatcccaggcttcaggaaataaattttccactgcaattccaactttacttggcaatattcaaggagaagaattgctggtttctgaatgtgagggaggaagtcctcctgcatctcaggatagcaataaggatgaacctaaaagtggattaaatgaagaccaagccatgatgcaggattgttacagcaaaattgtagataagctgtcctctgcaaaccccaccatggtattacaggtacaaagaaactcacatgttgtagaagaattttttatagaataataaaaattgcttttgccaatctgtattgacaat

SEQ ID NO: 419967 - DNA, 726 bp, Homo sapiens
  misc_feature (1)..(1): n is a, c, g, or t
  misc_feature (3)..(5): n is a, c, g, or t
  misc_feature (7)..(7): n is a, c, g, or t
  misc_feature (9)..(9): n is a, c, g, or t
  misc_feature (46)..(46): n is a, c, g, or t
ngnnnananagagtttcactctgttgcccaggctggagtgcagtgncgcaatctcggctcactgcagcctctgccctctgagttcaagtgattctcctgcctcagcctcctgagtagctgggattacaggtgtctgccaccgtgcccagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcatctgctttggagaacacagtttctaacagactttcaacagaggactgtcttattccactcttcagtgaagctttacgttcatgtaaacagcatgacgtgaggccatggatgcaggcattaaggtatactatgtaccagaatcagttgttggagaaaattaaaggtaagtggtttttttttcttgtaagagaaaattaaaggtgttcttttttaaattttgctttattgaggtttatattacacattctaagtgtatggtttgatgagttctaacatgtcttcacttgtgtgaccaccaatacgatcgagat

SEQ ID NO: 419968 - DNA, 355 bp, Homo sapiens
gtagctgggactacaggtgcccaccatcacactcggctgatttttttgtatttttagtagagacggggtttctccatgttggtcaggctggtcttgaactcctgacctcaggtgatctgcccacctcggcctgccaaagtgctggattacaggcgtgagccaccgcgcccggcctaataacacttcttcttaatgccagaaggctttctagactctcacagcatgcagctgtgagatgtactgactttgtatgttcccaccaaaggcattacttttcagcgaaggttttaactccttttgtttttctgtagactactacatgctcagtacggtgaattaatccaaccgagaaatg

SEQ ID NO: 419969 - DNA, 590 bp, Homo sapiens
atatgtaggtatgcttcctgtatttatttctaaagtagtttctctttccttgatgccttattgatgtgataaacagcttggggaataaatctgtctttattttggaaatggtttttagaagcctagttttggccttaattacttaggggatgtataacagcacaggctttggggtgagatggatttgtattcaaatgagacttgggtatataaacttgtacttaacttccttaagctctgatttccttaactgtagttaacatcttcagaattactatttaaatggtgcatgtgagtgatccaagaaatttattagccatgttctacctcaagaagactttcacctggatgtgatttttttcagtgtgtcttttctgttacttctccctgcttacctcccattggctgcagctgggatttttttctcttccgccagtcctaggttgcgcctcccttcccttatttatctaaacgcttttttcctgctgattttaatacatttctttttctctcaacagtggcaacatgaagatctacttatcaatagaccacaagccatgtcagtcacacctcccccacggtctgctatc

SEQ ID NO: 419970 - DNA, 1232 bp, Homo sapiens
gggggcgcaccccccgcggccgcacaccgagacccccggggaaaaaaaaagggaagcttggattacaaaactcttagaagaattgagagaagccaaagaaaaccatacaccagagatgaaacatttcgtgggcttagaaaagaaaattaagcagatggaaatgagacatgcacaaagagaacaggaacttcaacagataatacagcaaacacaccaagtagtagaaactgagcaaaacaaagaagttgaaaaatggaaaagactggcacagttaaagaatcgtgagctggagaagttccgcacagaactagactcaatattagatgttctccgagagctgcaccggcaaggagtggttgtgccagttgcttttgcagatgaaatgaatgcaccagagtattaatagaaattcagatttcataatgaccttattaaaaggcctgaagatggatgggattgtgccactgtcaggacagcttatgaaaaacaagtgttccaatatgtttccagaaagcaaacaaccaaagcaacatttcaaaataaattgcctttaaccaataagaaaaaaaacatataatggtgtattttactaaaaatcattaaccagtctcattttaagtgatttatggacagtttcctttatagcagagaagggctcacttgtatgctagaaatagaaagaaaagaaaattgaacatactccgccacatttttattgataatgtgaggtttttaaaatttttattttagatccagggggtacatgtgcttgttgtaacatgggtgtattgaataatggtgggaattgggcttctagtgtacccatcatccaaatattaaacactgtacccaacaggtaatttttcaacgcttactgccgctcacactctttcccctattggagtccccagtgtctgttatctccatctttatgtctctgtgtacccattgtttagctcctacttttaagtgagaatatatgcaatattttattttttatgtctgatttagttcacataggataatggcctccagctctatccatgttgctgcaaatgacatgatttcattcttttttatagttgcataatactccatttatatatctctctctatatatatctcacgttttctttatccagtcaattgttggtagatacttaggttggttccatgaatttgctattgtaaatattgctgcaataaacatacatgtacagatatctttttta

SEQ ID NO: 419971 - DNA, 563 bp, Homo sapiens
gggggcgcaccccccgcggccgcacaccgagacccccggggaaaaaaaaagggaagcttggattacaaaactcttagaagaattgagagaagccaaagaaaaccatacaccagagatgaaacatttcgtgggcttagaaaagaaaattaagcagatggaaatgagacatgcacaaagagaacaggaacttcaacagataatacagcaaacacaccaagtagtagaaactgagcaaaacaaagaagttgaaaaatggaaaagactggcacagttaaagaatcgtgagctggagaagttccgcacagaactagactcaatattagatgttctccgagagctgcaccggcaaggagtggttgtgccagttgcttttgcagatgaaatgaatgcaccagagtattaatagaaattcagatttcataatgaccttattaaaaggcctgaagatggatgggattgtgccactgtcaggacagcttatgaaaaacaagtgttccaatatgtttccagaaagcaaacaaccaaagcaacatttcaaaataaattgcctttaaccaataaga

SEQ ID NO: 419972 - DNA, 525 bp, Homo sapiens
tggggggatttttaccggaagggttaccaaattttttggaggattggggggagcccaaagaaaaccatacaccagagatgaaacatttcgtgggcttagaaaagaaaattaagcagatggaaatgagacatgcacaaagagaacaggaacttcaacagataatacagcaaacacaccaagtagtagaaactgagcaaaacaaagaagttgaaaaatggaaaagactggcacagttaaagaatcgtgagctggagaagttccgcacagaactagactcaatattagatgttctccgagagctgcaccggcaaggagtggttgtgccagttgcttttgcagatgaaatgaatgcaccagagtattaatagaaattcagatttcataatgaccttattaaaaggcctgaagatggatgggattgtgccactgtcaggacagcttatgaaaaacaagtgttccaatatgtttccagaaagcaaacaaccaaagcaacatttcaaaataaattgcctttaaccaataaga

SEQ ID NO: 419973 - DNA, 5162 bp, Homo sapiens
tgtttccaatgtttgaggtactttagaatgtttactttgggaggtcaaaattgttgactatggctaactgttcccaagaagagctagatgaagagtttgaacagtttatgaaagagctttcagatgattcttttgaaaattcagacaaaacagctagacaatctaaaaaagagatgaagaagaaagatacagtgccttggtggataactgaagatgattttaaagatgatgttatctactgaactccgggttattcctcctcattcctcaaagattttagctgctgtttcactgacttcttggaacaaatgtgagctatttgaaaacaaagaagacttctcagcctgttatggaaatagaagaggagtctgctgaaaagattcaatttcttaagagcagtggaacctctctcttaagtactgatagcttagaaacaaatgaactagtagtttctgagctcaaccatagtagtctcggagtgggattggacacattagaagaacaagaggagaaagaacaattttttgccaggcttgagaaaggcttgacatcttccattgattattcgagattaaataaggaattggattctaatgactctacacattttaaagctttacatattaatcaagccaacgcagaactaactgatgacgaacatgagaatgaatcgaaacatgaagaactggcagaaaattacagtgatgattttgaagatgagtatgttggtgcaccgttgactactaaagatgaagagatgccttccaaagagaattccaaatcagaaaaaataagtgtgcccaaacaggaagaagaaaaaactggcatgcttgctaatgttgtgctgcttgattcattagactctgttgcagaggtcaatcttgatgaacaagataaaataacacctaagccaaggtgcctaccagaaatgactgagaatgaaatgacaggaacaggtgtttcttatggacaaagcagtagtgacgttgaagccctacatcaagcttattgtcatatagcccattcattgggagatgaagacaaacaaaaaattgagagtaacacagtggaagatatcaagagctcagtgaaaggtcatcctcaagaaaatgaagagaattcaaaaaacatctctactatggaatctgatctgcccacagtagaggagctgatgaaacctatcagaatagattcctttgggatcagtggttttgatttacaacctgtcagctctgagaaagtggccgaaagaaaagaaactgaattttttagctctttacccctgaagatgaacccaaatattttgtctcaagactcacaacatgtgaaccttttttttgacaaaaatgatgagaatgtgattttacaaaagaccacaaatgagagtatggaaaacagctgtccacaagtaactgaagtaactgccacagaagaacatgttgataaaatgtaccttaatattttgaggaaaaaaataactgttaattcttcatcattatctcaggatgacaaaattaataaaacttacagatctcaacttagttctgaagaagaaggggctgtaatgggtaaacaggtaccatacaagaaggccagaagtgcacctcctttacttaaaaggaaaccccagagtggattatatgcgtcagttaggagctcaggctatggcaaacccagttcaccactcaagatgttttctactcttgaaaagaaaacttcagaggacattataaaaagcaaaaacttgagatcgatttctacctccaatcaacctaggaaaaaagaaatcttatctggaacaaaactcatcaagcctgcagctttggataaaccagctcacaaaactgaaagttgcctgtctactcgtaagaagtctgaaaatcccacagaaactgattcctgtattcagtttcagactgattccttaggatactgtggtgagaacaaggagaagaaattacttatgtttaaaagagttcaggaagcagaggataaatggaggggtgcgcaagccctaattgagcaaattaaagccacattctcagaaaaggagaaagaactagaaaataagttggaagaactaaagaaacaacaggaaaaagaactcttcaaattgaatcaagataattatattcttcaagccaagttaagcagctttgaagaaacaaacaaaaaacaaaggtggttacattttggagaagcagctgatcctgtcactggagaaaagttgaagcaaatccaaaaagaaatacaagaacaagagacacttcttcaaggatatcaacaggaaaatgaacgattatataatcaagtaaaagatctccaagaacaaaacaagaaaaatgaggagcgaatgtttaaggaaaaccaaagtttattcagtgaggtagcttccttaaaagaacagatgcacaaaagtcgttttctgtctcaagtagttgaagattcagagcccacaagaaatcagaattttacagatctgttagcagaactacggatggcacagaaagaaaaagacagtttattggaagacatcaaaagactgaaacaagacaaacaagctcttgaagtagacttcgaaaaaatgaagaaagagagggaccaagccaaagatcagattgcttatgtcacaggtgagaaattatatgaaataaaaattttagaagaaacacataaacaagaaatcagtcgtctgcaaaaaagattacagtggtatgctgaaaatcaggaacttctggataaagatgcacttcggcttagagaagcaaatgaggaaattgagaagctcaaacttgagattgagaaactgaaagctgaatctgggaatccatctattcggcagaagatacgcttaaaagataaagcagcagatgccaaaaaaattcaggatctggagcgacaagttaaggaaatggaagggattctgaagagaagatatcccaattctttacctgctttaatattggctgcatcagcagctggtgatacagtggataaaaatacagtggaatttatggagaaaaggataaaaaagctagaagctgatctggagggcaaagatgaagatgcaaagaaaagccttcgtaccatggaacaacagtttcagaaaatgaagattcagtatgaacaaagactagagcagcaggagcagctacttgcctgcaaattgaatcaacatgactctcccagaattaaagccctagagaaggaacttgatgacatcaaggaagcccatcagatcactgtaagaaaccttgaagccgaaatagacgttcttaaacatcagaatgctgaattagacgtcaagaaaaatgataaagatgatgaagattttcagtctatagaattccaggtggaacaggctcatgctaaagctaaattagtaagactcaatgaagaactggctgcaaaaaagagagaaatacaagacctctcaaaaactgtggagaggcttcagaaagacagaagaatgatgctatcaaatcagaactcaaagggcagagaggaaatgtctgccaaaagggcaaagaaagatgttttgcactcaagtaaaggaaatgctaactccttccctggaaccctggacagcaagctgtaccaaccacatactttcactgattcccatgtttcagaagttttacaagaaaactacagattaaaaaatgagctagaaggattaatttcagagaagaatgaactgaagatgaaatctgaagcagtgatgaatcaatttgaaaactccatgagaagggtcaaggaagatactgcagcacacattgcatccctcaaagcatctcatcagagagaaatagagaaactcctttgccaaaatgcagtagaaaattcttcttccaaagtagctgaactaaatcgtaaaatagcaactcaagaggtacttataagacatttccaaagtcaagttaatgagctgcagagtaaacaagagtctctcgtagtttctgaagttcgagaagaaattctacagaaagagattacaaaactcttagaagaattgagagaagccaaagaaaaccatacaccagagatgaaacatttcgtgggcttagaaaagaaaattaagcagatggaaatgagacatgcacaaagagaacaggaacttcaacagataatacagcaaacacaccaagtagtagaaactgagcaaaacaaagaagttgaaaaatggaaaagactggcacagttaaagaatcgtgagctggagaagttccgcacagaactagactcaatattagatgttctccgagagctgcaccggcaaggagtggttgtgccagttgcttttgcagatgaaatgaatgcaccagagtattaatagaaattcagatttcataatgaccttattaaaaggcctgaagatggatgggattgtgccactgtcaggacagcttatgaaaaacaagtgttccaatatgtttccagaaagcaaacaaccaaagcaacatttcaaaataaattgcctttaaccaataagaaaaaaaacatataatggtgtattttactaaaaatcattaaccagtctcattttaagtgatttatggacagtttcctttatagcagagaagggctcacttgtatgctagaaatagaaagaaaagaaaattgaacatactccgccacatttttattgataatgtgaggtttttaaaatttttattttagatccagggggtacatgtgcttgttgtaacatgggtgtattgaataatggtgggaattgggcttctagtgtacccatcatccaaatattaaacactgtacccaacaggtaatttttcaacgcttactgccgctcacactctttcccctattggagtccccagtgtctgttatctccatctttatgtctctgtgtacccattgtttagctcctacttttaagtgagaatatatgcaatattttattttttatgtctgatttagttcacataggataatggcctccagctctatccatgttgctgcaaatgacatgatttcattcttttttatagttgcataatactccatttatatatctctctctatatatatctcacgttttctttatccagtcaattgttggtagatacttaggttggttccatgaatttgctattgtaaatattgctgcaataaacatacatgtacagatatctttttta

SEQ ID NO: 419974 - DNA, 4431 bp, Homo sapiens
tgtttccaatgtttgaggtactttagaatgtttactttgggaggtcaaaattgttgactatggctaactgttcccaagaagagctagatgaagagtttgaacagtttatgaaagagctttcagatgattcttttgaaaattcagacaaaacagctagacaatctaaaaaagagatgaagaagaaagatacagtgccttggtggataactgaagatgattttaaagatgatggacttcttggaacaaatgtgagctatttgaaaacaaagaagacttctcagcctgttatggaaatagaagaggagtctgctgaaaagattcaatttcttaagagcagtggaacctctctcttaagtactgatagcttagaaacaaatgaactagtagtttctgagctcaaccatagtagtctcggagtgggattggacacattagaagaacaagaggagaaagaacaattttttgccaggcttgagaaaggcttgacatcttccattgattattcgagattaaataaggaattggattctaatgactctacacattttaaagctttacatattaatcaagccaacgcagaactaactgatgacgaacatgagaatgaatcgaaacatgaagaactggcagaaaattacagtgatgattttgaagatgagtatgttggtgcaccgttgactactaaagatgaagagatgccttccaaagagaattccaaatcagaaaaaataagtgtgcccaaacaggaagaagaaaaaactggcatgcttgctaatgttgtgctgcttgattcattagactctgttgcagaggtcaatcttgatgaacaagataaaataacacctaagccaaggtgcctaccagaaatgactgagaatgaaatgacaggaacaggtgtttcttatggacaaagcagtagtgacgttgaagccctacatcaagcttattgtcatatagcccattcattgggagatgaagacaaacaaaaaattgagagtaacacagtggaagatatcaagagctcagtgaaaggtcatcctcaagaaaatgaagagaattcaaaaaacatctctactatggaatctgatctgcccacagtagaggagctgatgaaacctatcagaatagattcctttgggatcagtggttttgatttacaacctgtcagctctgagaaagtggccgaaagaaaagaaactgaattttttagctctttacccctgaagatgaacccaaatattttgtctcaagactcacaacatgtgaaccttttttttgacaaaaatgatgagaatgtgattttacaaaagaccacaaatgagagtatggaaaacagctgtccacaagtaactgaagtaactgccacagaagaacatgttgataaaatgtaccttaatattttgaggaaaaaaataactgttaattcttcatcattatctcaggatgacaaaattaataaaacttacagatctcaacttagttctgaagaagaaggggctgtaatgggtaaacaggtaccatacaagaaggccagaagtgcacctcctttacttaaaaggaaaccccagagtggattatatgcgtcagttaggagctcaggctatggcaaacccagttcaccactcaagatgttttctactcttgaaaagaaaacttcagaggacattataaaaagcaaaaacttgagatcgatttctacctccaatcaacctaggaaaaaagaaatcttatctggaacaaaactcatcaagcctgcagctttggataaaccagctcacaaaactgaaagttgcctgtctactcgtaagaagtctgaaaatcccacagaaactgattcctgtattcagtttcagactgattccttaggatactgtggtgagaacaaggagaagaaattacttatgtttaaaagagttcaggaagcagaggataaatggaggggtgcgcaagccctaattgagcaaattaaagccacattctcagaaaaggagaaagaactagaaaataagttggaagaactaaagaaacaacaggaaaaagaactcttcaaattgaatcaagataattatattcttcaagccaagttaagcagctttgaagaaacaaacaaaaaacaaaggtggttacattttggagaagcagctgatcctgtcactggagaaaagttgaagcaaatccaaaaagaaatacaagaacaagagacacttcttcaaggatatcaacaggaaaatgaacgattatataatcaagtaaaagatctccaagaacaaaacaagaaaaatgaggagcgaatgtttaaggaaaaccaaagtttattcagtgaggtagcttccttaaaagaacagatgcacaaaagtcgttttctgtctcaagtagttgaagattcagagcccacaagaaatcagaattttacagatctgttagcagaactacggatggcacagaaagaaaaagacagtttattggaagacatcaaaagactgaaacaagacaaacaagctcttgaagtagacttcgaaaaaatgaagaaagagagggaccaagccaaagatcagattgcttatgtcacaggtgagaaattatatgaaataaaaattttagaagaaacacataaacaagaaatcagtcgtctgcaaaaaagattacagtggtatgctgaaaatcaggaacttctggataaagatgcacttcggcttagagaagcaaatgaggaaattgagaagctcaaacttgagattgagaaactgaaagctgaatctgggaatccatctattcggcagaagatacgcttaaaagataaagcagcagatgccaaaaaaattcaggatctggagcgacaagttaaggaaatggaagggattctgaagagaagatatcccaattctttacctgctttaatattggctgcatcagcagctggtgatacagtggataaaaatacagtggaatttatggagaaaaggataaaaaagctagaagctgatctggagggcaaagatgaagatgcaaagaaaagccttcgtaccatggaacaacagtttcagaaaatgaagattcagtatgaacaaagactagagcagcaggagcagctacttgcctgcaaattgaatcaacatgactctcccagaattaaagccctagagaaggaacttgatgacatcaaggaagcccatcagatcactgtaagaaaccttgaagccgaaatagacgttcttaaacatcagaatgctgaattagacgtcaagaaaaatgataaagatgatgaagattttcagtctatagaattccaggtggaacaggctcatgctaaagctaaattagtaagactcaatgaagaactggctgcaaaaaagagagaaatacaagacctctcaaaaactgtggagaggcttcagaaagacagaagaatgatgctatcaaatcagaactcaaagggcagagaggaaatgtctgccaaaagggcaaagaaagatgttttgcactcaagtaaaggaaatgctaactccttccctggaaccctggacagcaagctgtaccaaccacatactttcactgattcccatgtttcagaagttttacaagaaaactacagattaaaaaatgagctagaaggattaatttcagagaagaatgaactgaagatgaaatctgaagcagtgatgaatcaatttgaaaactccatgagaagggtcaaggaagatactgcagcacacattgcatccctcaaagcatctcatcagagagaaatagagaaactcctttgccaaaatgcagtagaaaattcttcttccaaagtagctgaactaaatcgtaaaatagcaactcaagaggtacttataagacatttccaaagtcaagttaatgagctgcagagtaaacaagagtctctcgtagtttctgaagttcgagaagaaattctacagaaagagattacaaaactcttagaagaattgagagaagccaaagaaaaccatacaccagagatgaaacatttcgtgggcttagaaaagaaaattaagcagatggaaatgagacatgcacaaagagaacaggaacttcaacagataatacagcaaacacaccaagtagtagaaactgagcaaaacaaagaagttgaaaaatggaaaagactggcacagttaaagaatcgtgagctggagaagttccgcacagaactagactcaatattagatgttctccgagagctgcaccggcaaggagtggttgtgccagttgcttttgcagatgaaatgaatgcaccagagtattaatagaaattcagatttcataatgaccttattaaaaggcctgaagatggatgggattgtgccactgtcaggacagcttatgaaaaacaagtgttccaatatgtttccagaaagcaaacaaccaaagcaacatttcaaaataaattgcctttaaccaataaga

SEQ ID NO: 419975 - DNA, 2308 bp, Homo sapiens
aaagaattaactttattacttttacaagacctatttttatattaaaaggttaaggaaatggaagggattctgaagagaagatatcccaattctttacctgctttaatattggctgcatcagcagctggtgatacagtggataaaaatacagtggaatttatggagaaaaggataaaaaagctagaagctgatctggagggcaaagatgaagatgcaaagaaaagccttcgtaccatggaacaacagtttcagaaaatgaagattcagtatgaacaaagactagagcagcaggagcagctacttgcctgcaaattgaatcaacatgactctcccagaattaaagccctagagaaggaacttgatgacatcaaggaagcccatcagatcactgtaagaaaccttgaagccgaaatagacgttcttaaacatcagaatgctgaattagacgtcaagaaaaatgataaagatgatgaagattttcagtctatagaattccaggtggaacaggctcatgctaaagctaaattagtaagactcaatgaagaactggctgcaaaaaagagagaaatacaagacctctcaaaaactgtggagaggcttcagaaagacagaagaatgatgctatcaaatcagaactcaaagggcagagaggaaatgtctgccaaaagggcaaagaaagatgttttgcactcaagtaaaggaaatgctaactccttccctggaaccctggacagcaagctgtaccaaccacatactttcactgattcccatgtttcagaagttttacaagaaaactacagattaaaaaatgagctagaaggattaatttcagagaagaatgaactgaagatgaaatctgaagcagtgatgaatcaatttgaaaactccatgagaagggtcaaggaagatactgcagcacacattgcatccctcaaagcatctcatcagagagaaatagagaaactcctttgccaaaatgcagtagaaaattcttcttccaaagtagctgaactaaatcgtaaaatagcaactcaagaggtacttataagacatttccaaagtcaagttaatgagctgcagagtaaacaagagtctctcgtagtttctgaagttcgagaagaaattctacagaaagagattacaaaactcttagaagaattgagagaagccaaagaaaaccatacaccagagatgaaacatttcgtgggcttagaaaagaaaattaagcagatggaaatgagacatgcacaaagagaacaggaacttcaacagataatacagcaaacacaccaagtagtagaaactgagcaaaacaaagaagttgaaaaatggaaaagactggcacagttaaagaatcgtgagctggagaagttccgcacagaactagactcaatattagatgttctccgagagctgcaccggcaaggagtggttgtgccagttgcttttgcagatgaaatgaatgcaccagagtattaatagaaattcagatttcataatgaccttattaaaaggcctgaagatggatgggattgtgccactgtcaggacagcttatgaaaaacaagtgttccaatatgtttccagaaagcaaacaaccaaagcaacatttcaaaataaattgcctttaaccaataagaaaaaaaacatataatggtgtattttactaaaaatcattaaccagtctcattttaagtgatttatggacagtttcctttatagcagagaagggctcacttgtatgctagaaatagaaagaaaagaaaattgaacatactccgccacatttttattgataatgtgaggtttttaaaatttttattttagatccagggggtacatgtgcttgttgtaacatgggtgtattgaataatggtgggaattgggcttctagtgtacccatcatccaaatattaaacactgtacccaacaggtaatttttcaacgcttactgccgctcacactctttcccctattggagtccccagtgtctgttatctccatctttatgtctctgtgtacccattgtttagctcctacttttaagtgagaatatatgcaatattttattttttatgtctgatttagttcacataggataatggcctccagctctatccatgttgctgcaaatgacatgatttcattcttttttatagttgcataatactccatttatatatctctctctatatatatctcacgttttctttatccagtcaattgttggtagatacttaggttggttccatgaatttgctattgtaaatattgctgcaataaacatacatgtacagatatctttttta

SEQ ID NO: 419976 - DNA, 455 bp, Homo sapiens
atcccagttttatgagaagaaggaaaactaagcaaagaattaactttattacttttacaagacctatttttatattaaaaggtatgactgagtagattgggtcagggccaagaaaggatcagccaaatgtggtatgaagaactagaaatatttggccaggcgcggtggctcacgcctgtaatcccagcactttgggaggcagaggcaggagaatcacatgaagctaggagttcaagaccagggtggccaacatggtgaaaccctctctctgctaaaaaatagaaaaattagccaggcatggttttagctgggcttggtggtgcacacctgtaatcctagctacttgggagggtgaggcaagagaatcacttgaacctgggaggtagaagttggaatgagccaagatcatgccactgtacctcagcctgggtgatggagcaaaactccatctcaaa

SEQ ID NO: 419977 - DNA, 1428 bp, Homo sapiens
gggaacaatctcctcgttccagaagggcagggcgcgacagatggtgtccttgaggctctcgcaggtggggagttccccgggcttcaggctgcgtaccgacgctcctgggggacacaggcacgctgctttccctcccaagccagtgggcccccacccgactccccactctgcagcttcccagaggccttcccagcaaaggcagcccaccttgctaatggagttgtagtaggggtgcttctcgtccatcgggggcggcgggatgtcgaaggagcgcctccagatcttcacctgctcctccccgtgcttggcggccgtttctgccttgttgaggcctgtgaggcccccgtaatgccgctcattgaggcgccaagtgcgcaccacaggcagccacatctggtccgtgccgtccaggatggcccagagggtgcggatggcccgcttcagcactgacgtgtagcagatgtcaaactccatcttggcatccttgatggccttggctccccgcttggcctcctcggtccccttttcactcagctctgcatcgaaccagccacagaaacggttctcctggttccatgtgctctcgccgtgccggaccatcacgaggcgccaggctaggaggcggccctcagcaggcagaggaggagagccagaggagctggtgcagaccacagctttgtggagaggagtctggccttgtggaaggttatccaaaataacccagtgtatgaaaaccaggaaaatcttaacatgggagaaaagaagatgatcaatacatgcccatcctgagatgattcaactattggaatgatcagatacagacttcaaagcagctatttataaccagccttcagaaagtattggtgaatattcttaaacagaatggaaatgacaaagcatggagtccataaattagatgatagtttggaaaaagatataaacttacaaaccaagaagctcagtgaaccacacaactggataaattaacaacaaaagtccaagcttagacacatcataaagaaacttctgaaaactaaagaccaagaaaaataagatcagccagagaaaaacgatacatttcattcaggtgaacaattctttgaaagactggatcttcaccagaaactatagaggccagaaagaagtggaacatttttagttttgaaataactgtcacccaagaattctatatccagtaaaaatttctattttactggaataaaagaatgaaataaaataaagacattctcaaatgaaggcaagctgaggaaattcataaccaaagaatctgctttaaaaaaatgttaaaccaagttcttcagacagaagagattactgggggcaattcaaaactttgggaatgcaggaagaacatcataaatggcaaaagtccacataaatatgaaactattctttacttctttaaga

SEQ ID NO: 419978 - DNA, 1548 bp, Homo sapiens
ctgagtcaacatggggttctggaaggtggagggagcatcttcccatgtctctcccactgacagccaccaatcctggacagatgcaggagcagctgtcagtagacagataagaaaatgagatcagattcaaagttccgcagagaagtggtgaggtaacaagtattgcctagcctggacacacaggcggcttgaaacctcaagtgcaccaacagaaagagctccaggaagaatcagaggagtgggatgtgaagcccctcgaagtcagtgagttgggggaatccctccaatttttcttttcttctctaccccagctcctgggcagtaacatggaggtggcagtggtggcacagtgacggtagtgtgagctgggtacgcacttgaaacctgagagggtaacgctaccctctgtctagaggagccatggccccaaaagcatgggcaaccaccttctgcagctcctttctgcccccctgcgctgggccctggatgcagtttcagggagtatgcagcagggtaggtagggaaagagccccagatttgtggctggaggtcttggtagggatgttgcagggagctgttgtgtttcagggagagtacagagaagggagagatgaagtgagtgatccgataaagtgatatgtgaagtcattggcttgctgccaagctgcgcacagggctgaccctagatgcacattgcaggtcccagactgaccggtgtagatacaggactaatatgactagtagtgcaaacactttaaacagtcaacattctgcttaggatttaaacaaggtccagagtctcaacataatatttaaaatatccaggttatccaaaataacccagtgtatgaaaaccaggaaaatcttaacatgggagaaaagaagatgatcaatacatgcccatcctgagatgattcaactattggaatgatcagatacagacttcaaagcagctatttataaccagccttcagaaagtattggtgaatattcttaaacagaatggaaatgacaaagcatggagtccataaattagatgatagtttggaaaaagatataaacttacaaaccaagaagctcagtgaaccacacaactggataaattaacaacaaaagtccaagcttagacacatcataaagaaacttctgaaaactaaagaccaagaaaaataagatcagccagagaaaaacgatacatttcattcaggtgaacaattctttgaaagactggatcttcaccagaaactatagaggccagaaagaagtggaacatttttagttttgaaataactgtcacccaagaattctatatccagtaaaaatttctattttactggaataaaagaatgaaataaaataaagacattctcaaatgaaggcaagctgaggaaattcataaccaaagaatctgctttaaaaaaatgttaaaccaagttcttcagacagaagagattactgggggcaattcaaaactttgggaatgcaggaagaacatcataaatggcaaaagtccacataaatatgaaactattctttacttctttaaga

SEQ ID NO: 419979 - DNA, 1160 bp, Homo sapiens
gaatatttctggaatatctaaaggagggggcagagttggatgtggatattgcaggaagcttctgcagctcctttctgcccccctgcgctgggccctggatgcagtttcagggagtatgcagcagggtaggtagggaaagagccccagatttgtggctggaggtcttggtagggatgttgcagggagctgttgtgtttcagggagagtacagagaagggagagatgaagtgagtgatccgataaagtgatatgtgaagtcattggcttgctgccaagctgcgcacagggctgaccctagatgcacattgcaggtcccagactgaccggtgtagatacaggactaatatgactagtagtgcaaacactttaaacagtcaacattctgcttaggatttaaacaaggtccagagtctcaacataatatttaaaatatccaggttatccaaaataacccagtgtatgaaaaccaggaaaatcttaacatgggagaaaagaagatgatcaatacatgcccatcctgagatgattcaactattggaatgatcagatacagacttcaaagcagctatttataaccagccttcagaaagtattggtgaatattcttaaacagaatggaaatgacaaagcatggagtccataaattagatgatagtttggaaaaagatataaacttacaaaccaagaagctcagtgaaccacacaactggataaattaacaacaaaagtccaagcttagacacatcataaagaaacttctgaaaactaaagaccaagaaaaataagatcagccagagaaaaacgatacatttcattcaggtgaacaattctttgaaagactggatcttcaccagaaactatagaggccagaaagaagtggaacatttttagttttgaaataactgtcacccaagaattctatatccagtaaaaatttctattttactggaataaaagaatgaaataaaataaagacattctcaaatgaaggcaagctgaggaaattcataaccaaagaatctgctttaaaaaaatgttaaaccaagttcttcagacagaagagattactgggggcaattcaaaactttgggaatgcaggaagaacatcataaatggcaaaagtccacataaatatgaaactattctttacttctttaaga

SEQ ID NO: 419980 - DNA, 1374 bp, Homo sapiens
gggaacaatctcctcgttccagaagggcagggcgcgacagatggtgtccttgaggctctcgcaggtggggagttccccgggcttcaggctgcgtaccgacgctcctgggggacacaggcacgctgctttccctcccaagccagtgggcccccacccgactccccactctgcagcttcccagaggccttcccagcaaaggcagcccaccttgctaatggagttgtagtaggggtgcttctcgtccatcgggggcggcgggatgtcgaaggagcgcctccagatcttcacctgctcctccccgtgcttggcggccgtttctgccttgttgaggcctgtgaggcccccgtaatgccgctcattgaggcgccaagtgcgcaccacaggcagccacatctggtccgtgccgtccaggatggcccagagggtgcggatggcccgcttcagcactgacgtgtagcagatgtcaaactccatcttggcatccttgatggccttggctccccgcttggcctcctcggtccccttttcactcagctctgcatcgaaccagccacagaaacggttctcctggttccatgtgctctcgccgtgccggaccatcacgaggcgccaggctaggaggcggccctcagcaggcagaggaggagagccagaggagctggtgcagaccacagctttgtggagaggagtctggccttgtggaaggttatccaaaataacccagtgtatgaaaaccaggaaaatcttaacatgggagtcagatacagacttcaaagcagctatttataaccagccttcagaaagtattggtgaatattcttaaacagaatggaaatgacaaagcatggagtccataaattagatgatagtttggaaaaagatataaacttacaaaccaagaagctcagtgaaccacacaactggataaattaacaacaaaagtccaagcttagacacatcataaagaaacttctgaaaactaaagaccaagaaaaataagatcagccagagaaaaacgatacatttcattcaggtgaacaattctttgaaagactggatcttcaccagaaactatagaggccagaaagaagtggaacatttttagttttgaaataactgtcacccaagaattctatatccagtaaaaatttctattttactggaataaaagaatgaaataaaataaagacattctcaaatgaaggcaagctgaggaaattcataaccaaagaatctgctttaaaaaaatgttaaaccaagttcttcagacagaagagattactgggggcaattcaaaactttgggaatgcaggaagaacatcataaatggcaaaagtccacataaatatgaaactattctttacttctttaaga

SEQ ID NO: 419981 - DNA, 892 bp, Homo sapiens
gggaacaatctcctcgttccagaagggcagggcgcgacagatggtgtccttgaggctctcgcaggtggggagttccccgggcttcaggctgcgtaccgacgctcctgggggacacaggcacgctgctttccctcccaagccagtgggcccccacccgactccccactctgcagcttcccagaggccttcccagcaaaggcagcccaccttgctaatggagttgtagtaggggtgcttctcgtccatcgggggcggcgggatgtcgaaggagcgcctccagatcttcacctgctcctccccgtgcttggcggccgtttctgccttgttgaggcctgtgaggcccccgtaatgccgctcattgaggcgccaagtgcgcaccacaggcagccacatctggtccgtgccgtccaggatggcccagagggtgcggatggcccgcttcagcactgacgtgtagcagatgtcaaactccatcttggcatccttgatggccttggctccccgcttggcctcctcggtccccttttcactcagctctgcatcgaaccagccacagaaacggttctcctggttccatgtgctctcgccgtgccggaccatcacgaggcgccaggctaggaggcggccctcagcaggcagaggaggagagccagaggagctggtgcagaccacagctttgtggagaggagtctggccttgtggaaggggtgctcacaacgctggtggactgcaaaatgacagacgcactcgggacaacaacttggctcttatgaaataaacatatacttaccaaatgacccagtaatcctgtgcctatttacccaagagaaatgaagacccatgtgttacacgaaaacctgtacatgcatgtctgtagcagtacgattcatca

SEQ ID NO: 419982 - DNA, 420 bp, Homo sapiens
ggccaacaattccatttttaaaaatgagacttgaacagccacttcaccagtgaggacatagaagccagtgaacagatgttcaacgttatcaggcattagggaaatgaaaataaaaccacagtgagctactgttatgtacctactactagaaaagctaaagttaacaaatactgcaactatcaagtgctgacagggatacagagcaactgcctactgtggtgtttaacttacaggggtgctcacaacgctggtggactgcaaaatgacagacgcactcgggacaacaacttggctcttatgaaataaacatatacttaccaaatgacccagtaatcctgtgcctatttacccaagagaaatgaagacccatgtgttacacgaaaacctgtacatgcatgtctgtagcagtacgattcatca

SEQ ID NO: 419983 - DNA, 538 bp, Homo sapiens
  misc_feature (9)..(9): n is a, c, g, or t
  misc_feature (15)..(15): n is a, c, g, or t
  misc_feature (25)..(25): n is a, c, g, or t
cgaaaaatncagagncccaattganaaggtgccagaaattatgggagttatctgtgcccagttatccataatcagccagcctagagtccgccaacaaatcataaataccgtgagtttatttatatccagacccaagtacacagatatagtgctcagcttccttctgtgtcatccagtgccgtataacaggcacctggctgaggtgtggagaatgctgtcggtggagcttcccagcacgacctggattctgtggaggctcctgaggaagctgcagaaatgccataatgagcctgcacaggagaagatggcatatgtggctgtggctgtaagcccttgagctttgcccctctaatgtcagcccctcccaggatgactgaccccacaccccagtggagagtgttccttttggtccctctcaaagcctgcatctgtcatccatttataagtctacagtgtttctgccaagggattgacatggagggagctggggagagtgaaggagtcagaatgccttaatacaaactcgtccaacctgcaa

SEQ ID NO: 419984 - DNA, 944 bp, Homo sapiens
  misc_feature (2)..(2): n is a, c, g, or t
  misc_feature (4)..(4): n is a, c, g, or t
gncncgaggctgagaccggtgcgccgcgcgctagtggccgctcttccgcgggctagcgggcggtgggggcgccagcagcgcggaaggcgggcacgcgggccatggctccctgggcggaggccgagcactcggcgctgaacccgctgcgcgcggtgtggctcacgctgaccgccgccttcctgctgaccctactgctgcagctcctgccgcccggcctgctcccgggctgcgcgatcttccaggacctgatccgctatgggaaaaccaagtgtggggagccgtcgcgccccgccgcctgccgagcctttgatgtccccaagagatatttttcccacttttatatcatctcagtgctgtggaatggcttcctgctttggtgccttactcaatctctgttcctgggagcaccttttccaagctggcttcatggtttgctcagaattctcggggcggcacagttccagggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaagttaacctcagtcatgaagaatgcaaaccaggtgatggtttcaatgcctaaggacagtgaagtctggagcccaaagtacagtttcagcaaagctgtttgaaactctccattccatttctataccccacaagttttcactgaatgagcatggcagtgccactcaagaaaatgaatctccaaagtatcttcaaagaataaatactaatggcagatctgcga

SEQ ID NO: 419985 - DNA, 2534 bp, Homo sapiens
  misc_feature (2)..(2): n is a, c, g, or t
  misc_feature (4)..(4): n is a, c, g, or t
gncncgaggctgagaccggtgcgccgcgcgctagtggccgctcttccgcgggctagcgggcggtgggggcgccagcagcgcggaaggcgggcacgcgggccatggctccctgggcggaggccgagcactcggcgctgaacccgctgcgcgcggtgtggctcacgctgaccgccgccttcctgctgaccctactgctgcagctcctgccgcccggcctgctcccgggctgcgcgatcttccaggacctgatccgctatgggaaaaccaagtgtggggagccgtcgcgccccgccgcctgccgagcctttgatgtccccaagagatatttttcccacttttatatcatctcagtgctgtggaatggcttcctgctttggtgccttactcaatctctgttcctgggagcaccttttccaagctggcttcatggtttgctcagaattctcggggcggcacagttccagggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtccttgttggcctaactgtgctgagccaagtgccaatggatggcaggaatgcctacataacagggaaaaatctattgatgcaagcacggtggttccatattcttgggatgatgatgttcatctggtcatctgcccatcagtataagtgccatgttattctcggcaatctcaggaaaaataaagcaggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaagttaacctcagtcatgaagaatgcaaaccaggtgatggtttcaatgcctaaggacagtgaagtctggagcccaaagtacagtttcagcaaagctgtttgaaactctccattccatttctataccccacaagttttcactgaatgagcatggcagtgccactcaagaaaatgaatctccaaagtatcttcaaagaataaatactaatggcagatctgcgatttctgggtccactttctgagatgctttctaaaaccaaccaactgataaaaagtagatgagacttctccaagctgcttcacaagcaaactaaccgaaaaactgaaaatatacaaacagcttcacacacacacacacacacacacacacacacacacacacaaaggaagatcatcaatggctgcggtagcctagtaggaatggactatataataatatagcaggtgctcaataactgtttgttgcatttcagtaaaagcagaataacctttcaaaataataacaggctgggtgcaatggctcacacctgttaatcccagcacttcgggaggccaaggtgggcagttcgcttgggcccaagagttcgagaccagcctgggcaacatggtgaaaccctatctccgtgaaaaaatatgaaaattagccaagagtggtggcacatgcctgtagtcccagatacttgggagtgggctgggatgggagaatcgcttgagcccaggaggtcaagggtacagtgagccgaggtcatgccactgcactccagcctggcctgggcaacagagcaagaccctgtctcaaaataataataatatataattttacaccaaaagtttcaggaaaaaacgagtttgttggagttagtttatactttcacatatcaccacaaagatctccagttaaataactatcaatatccatttccattcatctccccctcaaatcatagcctaacagaacactttgaaagctcttttatttaatatttttttacatcctttgaagggagtgcttcaaaaatgaaagcatcagaagataaaatatttttatatttatgcatagcaagccttcatgaacggaagtgacacactctggattgaataatactgtagcctcattcatatgtagttattcaaattggattaatgtctgtgtgagtttatttgaactagcagaaagtatctgaagatattcaggaatagagtttatacttaaaatagcttatgttaaagaaaatacctgtgattaattcagagggaaataaatgcatggtataaaagaaaaccaaaaacttaaaaaataatactatagcctgagcaacacattaaaactgcacacttgtgcagcgtaagattctctggcttattggctgaggtgttaagtttattccttttatgaagatgtcctattacagtcagctaagcactaaagctttgcatttatatgtactttgctatgggggaaagaaccttatgattaat

SEQ ID NO: 419986 - DNA, 1277 bp, Homo sapiens
  misc_feature (2)..(2): n is a, c, g, or t
  misc_feature (4)..(4): n is a, c, g, or t
gncncgaggctgagaccggtgcgccgcgcgctagtggccgctcttccgcgggctagcgggcggtgggggcgccagcagcgcggaaggcgggcacgcgggccatggctccctgggcggaggccgagcactcggcgctgaacccgctgcgcgcggtgtggctcacgctgaccgccgccttcctgctgaccctactgctgcagctcctgccgcccggcctgctcccgggctgcgcgatcttccaggacctgatccgctatgggaaaaccaagtgtggggagccgtcgcgccccgccgcctgccgagcctttgatgtccccaagagatatttttcccacttttatatcatctcagtgctgtggaatggcttcctgctttggtgccttactcaatctctgttcctgggagcaccttttccaagctggcttcatggtttgctcagaattctcggggcggcacagttccagggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtccttgttggcctaactgtgctgagccaagtgccaatggatggcaggaatgcctacataacagggaaaaatctattgatgcaagcacggtggttccatattcttgggatgatgatgttcatctggtcatctgcccatcagtataagtgccatgttattctcggcaatctcaggaaaaataaagcaggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaagttaacctcagtcatgaagaatgcaaaccaggtgatggtttcaatgcctaaggacagtgaagtctggagcccaaagtacagtttcagcaaagctgtttgaaactctccattccatttctataccccacaagttttcactgaatgagcatggcagtgccactcaagaaaatgaatctccaaagtatcttcaaagaataaatactaatggcagatctgcga

SEQ ID NO: 419987 - DNA, 1930 bp, Homo sapiens
  misc_feature (2)..(2): n is a, c, g, or t
  misc_feature (4)..(4): n is a, c, g, or t
gncncgaggctgagaccggtgcgccgcgcgctagtggccgctcttccgcgggctagcgggcggtgggggcgccagcagcgcggaaggcgggcacgcgggccatggctccctgggcggaggccgagcactcggcgctgaacccgctgcgcgcggtgtggctcacgctgaccgccgccttcctgctgaccctactgctgcagctcctgccgcccggcctgctcccgggctgcgcgatcttccaggacctgatccgctatgggaaaaccaagtgtggggagccgtcgcgccccgccgcctgccgagcctttgatgtccccaagagatatttttcccacttttatatcatctcagtgctgtggaatggcttcctgctttggtgccttactcaatctctgttcctgggagcaccttttccaagctggcttcatggtttgctcagaattctcggggcggcacagttccagggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtccttgttggcctaactgtgctgagccaagtgccaatggatggcaggaatgcctacataacagggaaaaatctattgatgcaagcacggtggttccatattcttgggatgatgatgttcatctggtcatctgcccatcagtataagtgccatgttattctcggcaatctcaggaaaaataaagcaggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaagttaacctcagtcatgaagaatgcaaaccaggtgatggtttcaatgcctaaggacagtgaagtctggagcccaaagtacagtttcagcaaagctgtttgaaactctccattccatttctataccccacaagttttcactgaatgagcatggcagtgccactcaagaaaatgaatctccaaagtatcttcaaagaataaatactaatggcagatctgcgatttctgggtccactttctgagatgctttctaaaaccaaccaactgataaaaagtagatgagacttctccaagctgcttcacaagcaaactaaccgaaaaactgaaaatatacaaacagcttcacacacacacacacacacacacacacacacacacacacaaaggaagatcatcaatggctgcggtagcctagtaggaatggactatataataatatagcaggtgctcaataactgtttgttgcatttcagtaaaagcagaataacctttcaaaataataacaggctggtctcaaactcctgacctcaggtgatccacctgcttcggcctcccaaagtgctgggattacaggtgtaagtcactgctcccggatgcatgtcaagcacattggaaagttcttacaacaattctgatggaggattttctctcccatcaaccaaacaccacttaagattaacctgtggctcagtctacttaaataaatgccatatttattttacttatcatttagaatttgccattctcaggaacaaaactttttgtacattggaaatggaaaacattgcagtttggtcttaatttccacatgaatatcaagtgtaatttttaataaattatttggagaaaaatgtaaaaaaagtcgacgcggccgc

SEQ ID NO: 419988 - DNA, 397 bp, Homo sapiens
agagatagagtttcaccatgttggccaggctggtctcaaactcctgacctcaggtgatccacctgcttcggcctcccaaagtgctgggattacaggtgtaagtcactgctcccggatgcatgtcaagcacattggaaagttcttacaacaattctgatggaggattttctctcccatcaaccaaacaccacttaagattaacctgtggctcagtctacttaaataaatgccatatttattttacttatcatttagaatttgccattctcaggaacaaaactttttgtacattggaaatggaaaacattgcagtttggtcttaatttccacatgaatatcaagtgtaatttttaataaattatttggagaaaaatgtaaaaaaagtcgacgcggccgc

SEQ ID NO: 419989 - DNA, 716 bp, Homo sapiens
tacgaggcacactgttgtttgtttgaacatgatcctggcaacagtgtgatctgggccgtctctttgaggtgagtgaaacttgttcctcactgtggaatccgtatgtgtgttttcagaatgaaagtttttctcgtagatgtaatcatttggtttttatcttttcatgttatggaattgagaaccagaaatctcaagcagatttaagtcataaaatgccctttgagggtcagctaacccatccccttgttttaaggggaagaggcacagagctgttcggtcatcggcttggactcacacagccgggtggcgccacggctggctgctctggtctcctggccctcaatcccactgcccttttcattgtcactgtgacagcaggacagagatagatttggtggtttgattggctgactagaaagaatatttagtttcaagttttaaaactgttaagatgactaacatctgttttgggtttttttggtctcctttttggtttttttctcgcagggctttcagcaatcgtgagaccgtctagtataagacagagcacgaaaggcatttttactgctggcctgaagaagtcagtgatttatagttcactaaaactgcacaaaatgtggaaagggtggctgaggaaaacatcctgattttgcttgcttttatatatgttatgtgtagatgaataaagtgtttgatcctttttgacaaaaaaaaaa

SEQ ID NO: 419990 - DNA, 3378 bp, Homo sapiens
tacgaggcacactgttgtttgtttgaacatgatcctggcaacagtgtgatctgggccgtctctttgaggtgagtgaaacttgttcctcactgtggaatccgtatgtgtgttttcagaatgaaagtttttctcgtagatgtaatcatttggtttttatcttttcatgttatggaattgagaaccagaaatctcaagcagatttaagtcataaaatgccctttgagggtcagctaacccatccccttgttttaaggggaagaggcacagagctgttcggtcatcggcttggactcacacagccgggtggcgccacggctggctgctctggtctcctggccctcaatcccactgcccttttcattgtcactgtgacagcaggacagagatagatttggtggtttgattggctgactagaaagaatatttagtttcaagttttaaaactgttaagatgactaacatctgttttgggtttttttggtctcctttttggtttttttctcgcagggctttcagcaatcgtgagaccgtctagtataagacagagcacgaaaggcatttttactgctggtaagagctttggaaatccgtgtgtaacatacctgctgactgagtggcttccacactcttggttacagtgtaaagctttgtatcttttaggtgcttgtgaaatgctgagctttgatggccataaactgggatattgcagtaaggtacaaacaggcataacagcagcagaacctggtggtcgaacaatgtcagaccattggcagtgctgttggaagctttactgcccttctgaattttctgagacacttcctgtgtgcagggtttttccctcatattgttttatttatcaaagttacagatgcataggattgcaaaaacagcagcatctgtgctccccctcctcttccccttctctgagacaactgcttccatctgtcttagtgggttatttttgttgttactgccatttctctaaatggtaagttttcgttggtccttctctacgtttcaactttaggtatcatctattgacttctctctatgggaggttagaagtcaactctggcacccaccctcatcaaatgtacgcaccctcccatccctctgtcctcctaatatagttgtctggtggttttggctaattagttttcagtttgatggtatggtgagccacagagtacacctttccttccctgcataatgttcttctctcatggagagtgtcttcgctgtcccctctagggggtcccccatttactgtatctcatgtctttcacttgcttggtgcacactctcattttggtgaagcacattttccagtaatttcctgagaaggggaacatggaaggcacatttggagaccacgtatgtctgaaagtcttttttgtctgtcttcacccatagttaatacttaggctgggtattgattagaaatcactttcctttaaaattttgagatcattgctgcatttatcttttacttctaggattgttgtctatgtctaaagccaatctgattcttaatcctttgtgtatgttatttctggaagcatgttaggtctttatttttccccagtgctctgaattctctcagtgatgtgctttgatgtgagtctgtttttatctgttttatctgttttaccgggaattcattgccctttctgttgggaaactcagaatataagcatataagaaaaatgttttaaattttttctttaattttgtcccatctgttttctctgttctctttctggaactccttttattcagatattgcaccccctagattagtctttggttttctttcttttgtcttctattttttatctgtttttcttttgctctgctttggaagattttctcgaatttctcaactttagcttccaacccttctgttgagtgtttataatttccaggaactctctcttttcttgctgttctctgaatgctcctgttttttgcatcctattcttgttttatggcctaaatatttgacatctctttggaggacaaagtggctgtatcagttcatcgtcccacaagcagagtaggagaatactcttttcttcccattttttccaacatttggcatcatcaagtgatagacttttctagttcaggctttcttcatgcaagcatccattgagcatctctcatgtgccagctgctcgggatacaaaagtgaacacaacgctgcgttagtctgttctcatgctgctaataaagacatacctcagactgggtaatttataaaggaaagaggtttaattgattagcagttccacatggctgggggtgtctcagaatcatggcggaaggtgaatgaggagcaaaatcatgtcttacatggcggcaggcaagagagcatgtgcaggggagctcccttttatagaaccatcagatctcgtaacacttattcactattatgaaaacagcacaggaaagacctgccttcgtgattcaattacctcccaccaggtccctcccacgacgtggggattattacaattcagggtaagatttgggtgggaacacagagccaaaccatatcaaatgctatactgacttccagaggcgtataatttagaagggaaaagagacatgctaacagaaatttgcaagagagggagaaatagcacagaggtagcccaaaaaggggagtgatctttcaacctaattctaatccctgggtttgagattgctggggagctggtatggtcacacctctcagtgtctcatagcccagctgcttggatactcctctgagcatttggccctcaaggaccgtgttgccctcctgaatcactggaaagattcaacaaggccaggcatggtggctcacacttataatcccagcactttgggaggccagggcgggaggattgcttgggctcaagagttcaagaccagtctgggcaacacagcaagaccctgtctctttaaaaataacaaaaataggccagatgcggtggctcacacctataatcccagcactttgggaggccaaggcaggaggatcacttgagtcctggagtttgagatcagcctgggcaacatggtggaaccctgtctctaaaaaaatagaaaaaataggctggatgtggtgactcatgcctgtaatcctagtactttgggaggccgagacaggcagattgcccgagctcaggggtttgagaccagcctgggcaacatggtgaaaccccgtctctactaaaatacaaaaaattagctgggcgtggtggcacatgcctgtagtcccacctttgagcggctgaggcaggagaattgcttgaacctgggaggcggaagttgcagtgagccaagattgtgccactgcctccggcctgggcgagagtgagacttcgtctc

SEQ ID NO: 419991 - DNA, 2942 bp, Homo sapiens
acttaaatataagtttattctaactaatcccaatatgtggcctcaaaacataagtccataaatgtcatttctaagattattttacataaatactcaaatttgttgtcatttttgtagccaaagctaagtagaggatggggcctgtgaatttagaaccatcctagtgataaatatcaaatatttagataaaaacctaaatatttacccctctagctttatggagccattaaataataacatttttctccttctcttcatagagtttatagacaaaactagaaaattcaggtatttggtatatacttttttgttttttttgataccatcttggtcttgtcacccaggctgtagtgcagtggcgtgatctcggctcattgcaacctccgcttcccgggctcaagcgattcccctgtcccagcctcctaagtagctgggactacaggcacatgccaccacgcctggctaattttttgtatttttagtagagacggggtttcaccatgttggccaggttggtcttgatctcctgacctcatggtctgcccgcctcggcctccctaagtgttgggattatggctgtaagccatgtcatttcactctcttaatggtgtcttttggtgaaaagaagttcataatttcatgtagtccagtttatccattttgttttctatatgtttagcagttttttgtgtcctgtttagaaaatttttgcctattccaaaatcatgaaatttaagttctccacctctgttgaaattataatattaaggcagaaaagactcttcattctgatctgttggttcttagccttttgcaagtccaggatccctgtgaaaatctgactagaactctggacgccctgcacagaagtgcacctacgcacacacacagtagattttcctgcagtgttagggagttcacagacactcagacttaatctgtggaccccttgttagagaacccctcatctattccaacccagtcattttacagataaggaaattgaggcccagggaaaggccactgttagtttgtggcccacctggaactagagtccaggtctcttgactccgattctagtgctctttctaacagatttccctgctgcagtctttctgaaaatgtctcactggcagaaccatgaaagggagaatgttttagtcaagggagatttctgtccactagcagcaacaaaaaaaaaaaatggctacatggtgacactcttctactttatgtatttaccttaaatgtttaagatccaggaactgctttttgaagttgagctgggaattatcatggcccatgcatcctcctctagctgtgactcagtgccctggggttgctatatgaacctttccatgtataactacctgtattcggcttggtcttttggttggttctggctggaattttaaaaaccaccttatataataagcttctagtctcaatgctgaagtgggtggggtttaccagagtggttgctccagggagaaaattaaaaggggtggaggcagggaaaggaactctgagtttgttgactaggttatgttggtttgcaagtagtcagctggtagacaaacgaagccagagtgtctggaagtattcattaatgattttactgctcccctgccactgtctgcagtggtcttttccaaggctctaagtggactaagcagtttacaggtaacagggccagatattttcaagccatcactcaaaccccagtgctaggcatgtccagagcgaaacctgttaccttgtcggcatgctcaccaaagtgcactgccaggggtgtgcactttacactcatagcacagatcacagtttgtgtctcacagtgaaaaagactgttcatatctttgggccacaccctgaaacacaaactgaatgatcccaccctcaacacaaaggaagttgagtccataatcgcatccacagataggatactcttagatctgacaaataacacccatttattttattccctttttcttctttcccctaagcccccggagagcctttctccagtttcatcacacactcctgactaagtagatgggggtgctagggggccagctctccgaatgaggcacatttgtcttgtcatttcaaaagctttcacagagcacctgctgtgttctgggtcctgtactaggtgacagggccacctaggtgaacagggcaaggtccctgtcctcaggaagctcccagtccaggcagaggcgtgggtgaatcggcccacacgtactgcacagtgtgttgagtgagcacagatgctgtggggccaccctgtgggtccagggaagcacttcctagagaagaaatccaaacagggattccaagtcaacgaggcagaaagtgatgggaacagcatttgtcatagtcagacaggtgcctttcacagtgacatagagacagtgaggtggggttggaatttaggcctgagagaacggggacccagtggcatacagagtcttatccttgtcctacctttttgaaagagctaaattcagaggctgccaatatgttcataactcaaaaggatcacttatcccaataacttaggaaccgttggcatccatagccctaaatcggaaaatgccgaaatcagaatcatttccccctacattgatcacagtgacctttaatcaccttcagctccctggtctcctagagccacgggtcagcccctcactgccctcctccaaagacaagtctgctcagaatgtcactgaaactctgagcatccactcaacaagcctccatcttcttactttctcatcttttctcttttaggcctgaagaagtcagtgatttatagttcactaaaactgcacaaaatgtggaaagggtggctgaggaaaacatcctgattttgcttgcttttatatatgttatgtgtagatgaataaagtgtttgatcctttttgacaaaaaaaaaa

SEQ ID NO: 419992 - DNA, 535 bp, Homo sapiens
tactccacttctggaatttttcttcccaatgttctgcttctttcaggtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcagatgagaaaactgaggcccagaatggttccctgtctaaggtcactcatctggtacatggtggactagtttgaataccagctttctaaaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggaggtaactgtatgtggaaaatagcttgtattgtttctaagacaaaggctatttgcaggaagaaagtcaggggtagaacagcatgactggtgtgagaacatttatag

SEQ ID NO: 419993 - DNA, 1563 bp, Homo sapiens
gtgcgtgcgtggggcgtagcaagggaccgaggctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggcccagttcagaccagaagtcatatctgacggcagcttccagaacatgctggctcccatatccacagagcactttcctccaacacggctccctacccttccctgtgcttcccccagtgcttccagcaagtctgtttaattcacgtgtccttcaagactcagatttgtcatctctaggagaatttctccctcctgtgcccctgatctgatccctatgctgagtgcgaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggagatagataaaagcccagaaggacagttcactcagctgatgacattgcccaaaaccttacagcaacagataaatcatattatggaccctcctggaaaaaacagagatgtggaagaaactttattccaagtggctcatgatcccgactgtggagatgtggtgcgactagggctttcagcaatcgtgagaccgtctagtataagacagagcacgaaaggcatttttactgctggcctgaagaagtcagtgatttatagttcactaaaactgcacaaaatgtggaaagggtggctgaggaaaacatcctgattttgcttgcttttatatatgttatgtgtagatgaataaagtgtttgatcctttttgacaaaaaaaaaa

SEQ ID NO: 419994 - DNA, 3540 bp, Homo sapiens
gtgcgtgcgtggggcgtagcaagggaccgaggctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggcccagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggagatagataaaagcccagaaggacagttcactcagctgatgacattgcccaaaaccttacagcaacagataaatcatattatggaccctcctggaaaaaacagagatgtggaagaaactttattccaagtggctcatgatcccgactgtggagatgtggtgcgactagggctttcagcaatcgtgagaccgtctagtataagacagagcacgaaaggcatttttactgctggtaagagctttggaaatccgtgtgtaacatacctgctgactgagtggcttccacactcttggttacagtgtaaagctttgtatcttttaggtgcttgtgaaatgctgagctttgatggccataaactgggatattgcagtaaggtacaaacaggcataacagcagcagaacctggtggtcgaacaatgtcagaccattggcagtgctgttggaagctttactgcccttctgaattttctgagacacttcctgtgtgcagggtttttccctcatattgttttatttatcaaagttacagatgcataggattgcaaaaacagcagcatctgtgctccccctcctcttccccttctctgagacaactgcttccatctgtcttagtgggttatttttgttgttactgccatttctctaaatggtaagttttcgttggtccttctctacgtttcaactttaggtatcatctattgacttctctctatgggaggttagaagtcaactctggcacccaccctcatcaaatgtacgcaccctcccatccctctgtcctcctaatatagttgtctggtggttttggctaattagttttcagtttgatggtatggtgagccacagagtacacctttccttccctgcataatgttcttctctcatggagagtgtcttcgctgtcccctctagggggtcccccatttactgtatctcatgtctttcacttgcttggtgcacactctcattttggtgaagcacattttccagtaatttcctgagaaggggaacatggaaggcacatttggagaccacgtatgtctgaaagtcttttttgtctgtcttcacccatagttaatacttaggctgggtattgattagaaatcactttcctttaaaattttgagatcattgctgcatttatcttttacttctaggattgttgtctatgtctaaagccaatctgattcttaatcctttgtgtatgttatttctggaagcatgttaggtctttatttttccccagtgctctgaattctctcagtgatgtgctttgatgtgagtctgtttttatctgttttatctgttttaccgggaattcattgccctttctgttgggaaactcagaatataagcatataagaaaaatgttttaaattttttctttaattttgtcccatctgttttctctgttctctttctggaactccttttattcagatattgcaccccctagattagtctttggttttctttcttttgtcttctattttttatctgtttttcttttgctctgctttggaagattttctcgaatttctcaactttagcttccaacccttctgttgagtgtttataatttccaggaactctctcttttcttgctgttctctgaatgctcctgttttttgcatcctattcttgttttatggcctaaatatttgacatctctttggaggacaaagtggctgtatcagttcatcgtcccacaagcagagtaggagaatactcttttcttcccattttttccaacatttggcatcatcaagtgatagacttttctagttcaggctttcttcatgcaagcatccattgagcatctctcatgtgccagctgctcgggatacaaaagtgaacacaacgctgcgttagtctgttctcatgctgctaataaagacatacctcagactgggtaatttataaaggaaagaggtttaattgattagcagttccacatggctgggggtgtctcagaatcatggcggaaggtgaatgaggagcaaaatcatgtcttacatggcggcaggcaagagagcatgtgcaggggagctcccttttatagaaccatcagatctcgtaacacttattcactattatgaaaacagcacaggaaagacctgccttcgtgattcaattacctcccaccaggtccctcccacgacgtggggattattacaattcagggtaagatttgggtgggaacacagagccaaaccatatcaaatgctatactgacttccagaggcgtataatttagaagggaaaagagacatgctaacagaaatttgcaagagagggagaaatagcacagaggtagcccaaaaaggggagtgatctttcaacctaattctaatccctgggtttgagattgctggggagctggtatggtcacacctctcagtgtctcatagcccagctgcttggatactcctctgagcagtgcccccttatcgagcatcgataaggggccaagccagacgagggacaggatatatgtacagggctgaactagcagagggtacaacttccaatggcccatatgagggtaccaactgagttg

SEQ ID NO: 419995 - DNA, 3211 bp, Homo sapiens
gtgcgtgcgtggggcgtagcaagggaccgaggctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggcccagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggagatagataaaagcccagaaggacagttcactcagctgatgacattgcccaaaaccttacagcaacagataaatcatattatggaccctcctggaaaaaacagagatgtggaagaaactttattccaagtggctcatgatcccgactgtggagatgtggtgcgactagggctttcagcaatcgtgagaccgtctagtataagacagagcacgaaaggcatttttactgctggtaagagctttggaaatccgtgtgtaacatacctgctgactgagtggcttccacactcttggttacagtgtaaagctttgtatcttttaggtgcttgtgaaatgctgagctttgatggccataaactgggatattgcagtaaggtacaaacaggcataacagcagcagaacctggtggtcgaacaatgtcagaccattggcagtgctgttggaagctttactgcccttctgaattttctgagacacttcctgtgtgcagggtttttccctcatattgttttatttatcaaagttacagatgcataggattgcaaaaacagcagcatctgtgctccccctcctcttccccttctctgagacaactgcttccatctgtcttagtgggttatttttgttgttactgccatttctctaaatggtaagttttcgttggtccttctctacgtttcaactttaggtatcatctattgacttctctctatgggaggttagaagtcaactctggcacccaccctcatcaaatgtacgcaccctcccatccctctgtcctcctaatatagttgtctggtggttttggctaattagttttcagtttgatggtatggtgagccacagagtacacctttccttccctgcataatgttcttctctcatggagagtgtcttcgctgtcccctctagggggtcccccatttactgtatctcatgtctttcacttgcttggtgcacactctcattttggtgaagcacattttccagtaatttcctgagaaggggaacatggaaggcacatttggagaccacgtatgtctgaaagtcttttttgtctgtcttcacccatagttaatacttaggctgggtattgattagaaatcactttcctttaaaattttgagatcattgctgcatttatcttttacttctaggattgttgtctatgtctaaagccaatctgattcttaatcctttgtgtatgttatttctggaagcatgttaggtctttatttttccccagtgctctgaattctctcagtgatgtgctttgatgtgagtctgtttttatctgttttatctgttttaccgggaattcattgccctttctgttgggaaactcagaatataagcatataagaaaaatgttttaaattttttctttaattttgtcccatctgttttctctgttctctttctggaactccttttattcagatattgcaccccctagattagtctttggttttctttcttttgtcttctattttttatctgtttttcttttgctctgctttggaagattttctcgaatttctcaactttagcttccaacccttctgttgagtgtttataatttccaggaactctctcttttcttgctgttctctgaatgctcctgttttttgcatcctattcttgttttatggcctaaatatttgacatctctttggaggacaaagtggctgtatcagttcatcgtcccacaagcagagtaggagaatactcttttcttcccattttttccaacatttggcatcatcaagtgatagacttttctagttcaggctttcttcatgcaagcatccattgagcatctctcatgtgccagctgctcgggatacaaaagtgaacacaacgctgcgttagtctgttctcatgctgctaataaagacatacctcagactgggcaacatggtggaaccctgtctctaaaaaaatagaaaaaataggctggatgtggtgactcatgcctgtaatcctagtactttgggaggccgagacaggcagattgcccgagctcaggggtttgagaccagcctgggcaacatggtgaaaccccgtctctactaaaatacaaaaaattagctgggcgtggtggcacatgcctgtagtcccacctttgagcggctgaggcaggagaattgcttgaacctgggaggcggaagttgcagtgagccaagattgtgccactgcctccggcctgggcgagagtgagacttcgtctc

SEQ ID NO: 419996 - DNA, 1044 bp, Homo sapiens
gtgcgtgcgtggggcgtagcaagggaccgaggctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggcccagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcagaggttagtatggttgctgcccagatgttctacaagggagagatttatatttgaagactgcggatatcctgttctcactcggccctggagctgctacagtcttagttgtaaatcacgtcactcttgagtggttcctgcactaacctcgtgatttgcctccctacctcctgggtcccctctccacatctccatgcttattgtcccagggt

SEQ ID NO: 419997 - DNA, 299 bp, Homo sapiens
actgataaggaattatgcccatagtcacagagctagtaagagatggagttggcatttgaacacatctcttaactgcagtgcaatctttaaaagtaagaatctcagaacagactgaagctcttagtatttttttttttttttgagacagggtctcaactgtgtctttcaggctggagtgtagtgtcatgatcatggctcactgcaacccactgcagcctcaaccacctggactgaagctgtcttcctacctcaacctcctgagtatctgggaccacacatgtgcatcactgtgcctggct

SEQ ID NO: 419998 - DNA, 1294 bp, Homo sapiens
gtgcgtgcgtggggcgtagcaagggaccgaggctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggcccagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggagatagataaaagcccagaaggacagttcactcagctgatgacattgcccaaaaccttacagcaacagataaatcatattatggaccctcctggaaaaaacagagatgtggaagaaactttattccaagtggctcatgatcccgactgtggagatgtggtgcgactaggcctgaagaagtcagtgatttatagttcactaaaactgcacaaaatgtggaaagggtggctgaggaaaacatcctgattttgcttgcttttatatatgttatgtgtagatgaataaagtgtttgatcctttttgacaaaaaaaaaa

SEQ ID NO: 419999 - DNA, 1357 bp, Homo sapiens
gtgcgtgcgtggggcgtagcaagggaccgaggctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggcccagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggagatagataaaagcccagaaggacagttcactcagctgatgacattgcccaaaaccttacagcaacagataaatcatattatggaccctcctggaaaaaacagagatgtggaagaaactttattccaagtggctcatgatcccgactgtggagatgtggtgcgactagggctttcagcaatcgtgagaccgtctagtataagacagagcacgaaaggcatttttactgctggcctgaagaagtcagtgatttatagttcactaaaactgcacaaaatgtggaaagggtggctgaggaaaacatcctgattttgcttgcttttatatatgttatgtgtagatgaataaagtgtttgatcctttttgacaaaaaaaaaa

SEQ ID NO: 420000 - DNA, 1474 bp, Homo sapiens
gtgcgtgcgtggggcgtagcaagggaccgaggctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggcccagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggagatagataaaagcccagaaggacagttcactcagctgatgacattgcccaaaaccttacagcaacagataaatcatattatggaccctcctggaaaaaacagagatgtggaagaaactttattccaagtggctcatgatcccgactgtggagatgtggtgcgactaggtacgtttatgaatttgatgttgaggaaatgccagccatggggaaaagcagactttgtttgtgattggaatgtattatttcttcctttttgtttagcgagatagagagattgcctctcagaagaagaaagcactaaaaatttgagggttttctaaatctgcatttttatttgtttgaagtaagatggtgaaaatacttctgtttttaaattcctggatcctaaatcactgtcaaagggagaaacaatgtttcttttggttcctagagcacaacttctagaatttatttaaaagatgtgtctgtgttttgtggtggtctgagaaaaa

SEQ ID NO: 420001 - DNA, 1052 bp, Homo sapiens
gtgcgtgcgtggggcgtagcaagggaccgaggctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggcccagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcagtatcagtgattcggatggtggtgggagatttacacgtgtgatttgtgagcatatagcatttgagagtcatggagcttaaggaattaggggttatagcgagtggtgaataaagccaagaagatcgtgagatgcaattagagatattggcccgaaagatggaatacggaacgggggagaaaagtaaagaggaaagttgtataaatctggctttgtcga

SEQ ID NO: 420002 - DNA, 895 bp, Homo sapiens
gtgcgtgcgtggggcgtagcaagggaccgaggctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggcccagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggctctctggcagtgtcccaagagttcactggcttttcactctgaacaacaaataacagtgctgctgagacaagttcctagttcacctttcattgaagaaccagatcagcacagtagcagaatcttccgaactgacatttttcctttgaggtctcaactgtgtctttcaggctggagtgtagtgtcatgatcatggctcactgcaacccac

SEQ ID NO: 420003 - DNA, 1063 bp, Homo sapiens
acaattcactgtgggtatttaaccatatttgcctttaattttgaacatacttaaggtttttagagttagaattaagacctttaaaattgtctcatgcatctcagttggctagacttataaccattaatattttgggattttgtcactacaaaaattcttagcatcaacttctattaataggatgaatcacattaatcagccatttatttgtcagtctccatagtaattatttaactcttctgtgtttaaagactaatgtgctttttactgacttgtacacacatttccacaggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctactgagctagttgattggtgatgcttctaccttaatatctttcctactgatttataattcctttattttcacatatactaaaactttttaaatgcatgttaattcagataaaaaggcattttgtattccacatagaatagtgttaagaattgtgaagtacactgagctgtcacggcaaagtagtatttaatgtgcttataggggtgtgtgtgtgtgtgtgtgtgtgtgtgtg

SEQ ID NO: 420004 - DNA, 369 bp, Homo sapiens
cgtctaacccggccctgccgtttaacccggccctaagaagagtgaaacagaatccaaatcagacataacataacaatgaaatggcagattcaggtataaaaaaggaaaaatacataatattcctcctacttacctctgagggcaaattgctgctgaaaacattatcatcatctttgttttcttcaccatttttctccacaggaacccattctccataaacactatccgcttcttttttccgatgttgagatccagatgatacagggaattcttttgttaatgttacctggctttttggtggagttggttttgctgcagcaatctaaaaaataaagtgtttcttaattaaagctcaatatgatatctaca

SEQ ID NO: 420005 - DNA, 2825 bp, Homo sapiens
gaatcacactcaggcagtctctctcctttctgaacagagatgagccctaagatacctggaagattttgtttttaacctcacattaaggaaagcacacatcaccttgaaagagctaaacttgacgtcctacagaatttctctaacttaacatgttgagtctctgagagtgcaaaacttgaaacaagagaaagtggcctgcctggcatcctctgcttattgaatggttttatttaattctcctttacattgccaccttaacaatccttccagctacgtatcttaaaggatgtgatggagaagttatcaactggtgttttcagacctcagttggatgaacccattccactgtatgaggcaaaagtttccatggaagctgttcagaaaaatcaaggaagaaaaaaggtagtgcacatcagcgccctggatcgcatactttccagaagcgtcgctgaacctggcgactggactctggccgaggacctggcagaagcgccagggcagggtcaccgctgggacagtgggcgttgacggccacccgggatcgccgctgcgggctgcgtctcgcgggctgcccactgcgcatgctccgctcggaaccggcgggggcggaggcggggccgcgtcgggggcgggagctcggcgaggcgccacgtcaggggcgggcccggcgcgcgcgggaagtctctgtagggcggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctac

SEQ ID NO: 420006 - DNA, 833 bp, Homo sapiens
acaattcactgtgggtatttaaccatatttgcctttaattttgaacatacttaaggtttttagagttagaattaagacctttaaaattgtctcatgcatctcagttggctagacttataaccattaatattttgggattttgtcactacaaaaattcttagcatcaacttctattaataggatgaatcacattaatcagccatttatttgtcagtctccatagtaattatttaactcttctgtgtttaaagactaatgtgctttttactgacttgtacacacatttccacaggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctac

SEQ ID NO: 420007 - DNA, 3055 bp, Homo sapiens
gaatcacactcaggcagtctctctcctttctgaacagagatgagccctaagatacctggaagattttgtttttaacctcacattaaggaaagcacacatcaccttgaaagagctaaacttgacgtcctacagaatttctctaacttaacatgttgagtctctgagagtgcaaaacttgaaacaagagaaagtggcctgcctggcatcctctgcttattgaatggttttatttaattctcctttacattgccaccttaacaatccttccagctacgtatcttaaaggatgtgatggagaagttatcaactggtgttttcagacctcagttggatgaacccattccactgtatgaggcaaaagtttccatggaagctgttcagaaaaatcaaggaagaaaaaaggtagtgcacatcagcgccctggatcgcatactttccagaagcgtcgctgaacctggcgactggactctggccgaggacctggcagaagcgccagggcagggtcaccgctgggacagtgggcgttgacggccacccgggatcgccgctgcgggctgcgtctcgcgggctgcccactgcgcatgctccgctcggaaccggcgggggcggaggcggggccgcgtcgggggcgggagctcggcgaggcgccacgtcaggggcgggcccggcgcgcgcgggaagtctctgtagggcggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctactgagctagttgattggtgatgcttctaccttaatatctttcctactgatttataattcctttattttcacatatactaaaactttttaaatgcatgttaattcagataaaaaggcattttgtattccacatagaatagtgttaagaattgtgaagtacactgagctgtcacggcaaagtagtatttaatgtgcttataggggtgtgtgtgtgtgtgtgtgtgtgtgtgtg

SEQ ID NO: 420008 - DNA, 2646 bp, Homo sapiens
gaatcacactcaggcagtctctctcctttctgaacagagatgagccctaagatacctggaagattttgtttttaacctcacattaaggaaagcacacatcaccttgaaagagctaaacttgacgtcctacagaatttctctaacttaacatgttgagtctctgagagtgcaaaacttgaaacaagagaaagtggcctgcctggcatcctctgcttattgaatggttttatttaattctcctttacattgccaccttaacaatccttccagctacgtatcttaaaggatgtgatggagaagttatcaactggtgttttcagacctcagttggatgaacccattccactgtatgaggcaaaagtttccatggaagctgttcagaaaaatcaaggaagaaaaaaggtagtgcacatcagcgccctggatcgcatactttccagaagcgtcgctgaacctggcgactggactctggccgaggacctggcagaagcgccagggcagggtcaccgctgggacagtgggcgttgacggccacccgggatcgccgctgcgggctgcgtctcgcgggctgcccactgcgcatgctccgctcggaaccggcgggggcggaggcggggccgcgtcgggggcgggagctcggcgaggcgccacgtcaggggcgggcccggcgcgcgcgggaagtctctgtagggcggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctac

SEQ ID NO: 420009 - DNA, 1656 bp, Homo sapiens
ttgtccaggcgggcgaaggggttcctccgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctac

SEQ ID NO: 420010 - DNA, 2783 bp, Homo sapiens
gaatcacactcaggcagtctctctcctttctgaacagagatgagccctaagatacctggaagattttgtttttaacctcacattaaggaaagcacacatcaccttgaaagagctaaacttgacgtcctacagaatttctctaacttaacatgttgagtctctgagagtgcaaaacttgaaacaagagaaagtggcctgcctggcatcctctgcttattgaatggttttatttaattctcctttacattgccaccttaacaatccttccagctacgtatcttaaaggatgtgatggagaagttatcaactggtgttttcagacctcagttggatgaacccattccactgtatgaggcaaaagtttccatggaagctgttcagaaaaatcaaggaagaaaaaaggtagtgcacatcagcgccctggatcgcatactttccagaagcgtcgctgaacctggcgactggactctggccgaggacctggcagaagcgccagggcagggtcaccgctgggacagtgggcgttgacggccacccgggatcgccgctgcgggctgcgtctcgcgggctgcccactgcgcatgctccgctcggaaccggcgggggcggaggcggggccgcgtcgggggcgggagctcggcgaggcgccacgtcaggggcgggcccggcgcgcgcgggaagtctctgtagggcggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacagagccttatctattggctccaccctgctttgtcttggctaccactgttccctcgtattggagctgatagaaaaatggctggaaagacaagtccttggtcaaatgatgcaaccctgcagcatgttttaatgagtgactggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctac

SEQ ID NO: 420011 - DNA, 2260 bp, Homo sapiens
gaatcacactcaggcagtctctctcctttctgaacagagatgagccctaagatacctggaagattttgtttttaacctcacattaaggaaagcacacatcaccttgaaagagctaaacttgacgtcctacagaatttctctaacttaacatgttgagtctctgagagtgcaaaacttgaaacaagagaaagtggcctgcctggcatcctctgcttattgaatggttttatttaattctcctttacattgccaccttaacaatccttccagctacgtatcttaaaggatgtgatggagaagttatcaactggtgttttcagacctcagttggatgaacccattccactgtatgaggcaaaagtttccatggaagctgttcagaaaaatcaaggaagaaaaaaggtagtgcacatcagcgccctggatcgcatactttccagaagcgtcgctgaacctggcgactggactctggccgaggacctggcagaagcgccagggcagggtcaccgctgggacagtgggcgttgacggccacccgggatcgccgctgcgggctgcgtctcgcgggctgcccactgcgcatgctccgctcggaaccggcgggggcggaggcggggccgcgtcgggggcgggagctcggcgaggcgccacgtcaggggcgggcccggcgcgcgcgggaagtctctgtagggcggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctac

SEQ ID NO: 420012 - DNA, 2525 bp, Homo sapiens
gaatcacactcaggcagtctctctcctttctgaacagagatgagccctaagatacctggaagattttgtttttaacctcacattaaggaaagcacacatcaccttgaaagagctaaacttgacgtcctacagaatttctctaacttaacatgttgagtctctgagagtgcaaaacttgaaacaagagaaagtggcctgcctggcatcctctgcttattgaatggttttatttaattctcctttacattgccaccttaacaatccttccagctacgtatcttaaaggatgtgatggagaagttatcaactggtgttttcagacctcagttggatgaacccattccactgtatgaggcaaaagtttccatggaagctgttcagaaaaatcaaggaagaaaaaaggtagtgcacatcagcgccctggatcgcatactttccagaagcgtcgctgaacctggcgactggactctggccgaggacctggcagaagcgccagggcagggtcaccgctgggacagtgggcgttgacggccacccgggatcgccgctgcgggctgcgtctcgcgggctgcccactgcgcatgctccgctcggaaccggcgggggcggaggcggggccgcgtcgggggcgggagctcggcgaggcgccacgtcaggggcgggcccggcgcgcgcgggaagtctctgtagggcggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctac

SEQ ID NO: 420013 - DNA, 2895 bp, Homo sapiens
gaatcacactcaggcagtctctctcctttctgaacagagatgagccctaagatacctggaagattttgtttttaacctcacattaaggaaagcacacatcaccttgaaagagctaaacttgacgtcctacagaatttctctaacttaacatgttgagtctctgagagtgcaaaacttgaaacaagagaaagtggcctgcctggcatcctctgcttattgaatggttttatttaattctcctttacattgccaccttaacaatccttccagctacgtatcttaaaggatgtgatggagaagttatcaactggtgttttcagacctcagttggatgaacccattccactgtatgaggcaaaagtttccatggaagctgttcagaaaaatcaaggaagaaaaaaggtagtgcacatcagcgccctggatcgcatactttccagaagcgtcgctgaacctggcgactggactctggccgaggacctggcagaagcgccagggcagggtcaccgctgggacagtgggcgttgacggccacccgggatcgccgctgcgggctgcgtctcgcgggctgcccactgcgcatgctccgctcggaaccggcgggggcggaggcggggccgcgtcgggggcgggagctcggcgaggcgccacgtcaggggcgggcccggcgcgcgcgggaagtctctgtagggcggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaacccatttttctcatcaaaacggctcccattcctccagttaccggggctgctcttaagaactgatcctatccaaagaaagaaaggatttatttgtagaattggaggtgtttactggaagatgatgatatggccaagccaaggaagggaacctacagtgaagagtacaggtgtctctgatctacatatccaagaactgcaagaaaaatgtccagatgggcatcagatacctagtccagtccttggcaaaagtctgggctttggaaaccaagggcaagaggcgatgacaactaatctatagaacccattctccataaacactatccgcttcttttttccgatgttgagatccagatgatacagggaattcttttgttaatgttacctggctttttggtggagttggttttgctgcagcaatctaaaaaataaagtgtttcttaattaaagctcaatatgatatctaca

SEQ ID NO: 420014 - DNA, 807 bp, Homo sapiens
gcaaaaggttgagagatgatcttaattttccttttctttacattttcatgaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctac

SEQ ID NO: 420015 - DNA, 2198 bp, Homo sapiens
gaatcacactcaggcagtctctctcctttctgaacagagatgagccctaagatacctggaagattttgtttttaacctcacattaaggaaagcacacatcaccttgaaagagctaaacttgacgtcctacagaatttctctaacttaacatgttgagtctctgagagtgcaaaacttgaaacaagagaaagtggcctgcctggcatcctctgcttattgaatggttttatttaattctcctttacattgccaccttaacaatccttccagctacgtatcttaaaggatgtgatggagaagttatcaactggtgttttcagacctcagttggatgaacccattccactgtatgaggcaaaagtttccatggaagctgttcagaaaaatcaaggaagaaaaaaggtagtgcacatcagcgccctggatcgcatactttccagaagcgtcgctgaacctggcgactggactctggccgaggacctggcagaagcgccagggcagggtcaccgctgggacagtgggcgttgacggccacccgggatcgccgctgcgggctgcgtctcgcgggctgcccactgcgcatgctccgctcggaaccggcgggggcggaggcggggccgcgtcgggggcgggagctcggcgaggcgccacgtcaggggcgggcccggcgcgcgcgggaagtctctgtagggcggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggtaataaaagtctgcataacctagcttttaagaagtactttactttgataggataaattcttgatttaaaaaaaaacctcctagcatttttacttggtacatattttcattttgctttcctcccatt

SEQ ID NO: 420016 - DNA, 808 bp, Homo sapiens
gcgctcccctggctaccccgctgcgggctgtgctcacgggacgcgttcccgaggaaagtgagggggccccagagggcagcgaggagccccttggagaggacttagaggtgacttggaaaagagctcgaaaaaccctgagagcccccatcttgcaaggacgctgttcgatggggcaggtgacaagccctgcttcccccgtgatttagggcctcccttctctcacgcactccaaattattctggagatgggggaatgtcgaggattcgtggggtcagaattcactagcatctgtcttacccaaagccttttggatctttcggtttgaaacgccggtccctgttcccctcaattttgatactaaagttcagacacaaaactgaagtgttgaaactcatagattggatggggtgcctctgaatttaggtgtacttgcgtttattgagaaacatgtatgccaggtgaggctctgtacatatttaacgcaaacttcagcatcctttaaattttaaaggagaatatatttaacctcagtttttagattctaatcaagaggtaatactttttaaatatcattagaatgtgtatttgtataaactttttttttataggatttgagcctatttttaaaaatacatttatacttctcagaagcattttgcttggaaagtagttttacagagaggcttgatcatctcaaccagggatgaaaataccgcatcagccaaggtaaaggagttggtttgatacagtaatgatgactgtaaagatagccagcgcactcttctttgggcagttgacttctccagtt

SEQ ID NO: 420017 - DNA, 870 bp, Homo sapiens
gcgctcccctggctaccccgctgcgggctgtgctcacgggacgcgttcccgaggaaagtgagggggccccagagggcagcgaggagccccttggagaggacttagaggtgacttggaaaagagctcgaaaaaccctgagagcccccatcttgcaaggacgctgttcgatggggcaggtgacaagccctgcttcccccgtgatttagggcctcccttctctcacgcactccaaattattctggagatgggggaatgtcgaggattcgtggggtcagaattcactagcatctgtcttacccaaagccttttggatctttcggtttgaaacgccggtccctgttcccctcaattttgatactaaagttcagacacaaaactgaagtgttgaaactcatagattggatggggtgcctctgaatttaggtgtacttgcgtttattgagaaacatgtatgccaggtgaggctctgtacatatttaacgcaaacttcagcatcctttaaattttaaaggagaatatatttaacctcagtttttagattctaatcaagaaaatgatttgctatgggaagagaagtttcctgaaagaacaactgttactgaattacctcagaggtaatactttttaaatatcattagaatgtgtatttgtataaactttttttttataggatttgagcctatttttaaaaatacatttatacttctcagaagcattttgcttggaaagtagttttacagagaggcttgatcatctcaaccagggatgaaaataccgcatcagccaaggtaaaggagttggtttgatacagtaatgatgactgtaaagatagccagcgcactcttctttgggcagttgacttctccagtt

SEQ ID NO: 420018 - DNA, 2135 bp, Homo sapiens
gcgctcccctggctaccccgctgcgggctgtgctcacgggacgcgttcccgaggaaagtgagggggccccagagggcagcgaggagccccttggagaggacttagaggtgacttggaaaagagctcgaaaaaccctgagagcccccatcttgcaaggacgctgttcgatggggcaggtgacaagccctgcttcccccgtgatttagggcctcccttctctcacgcactccaaattattctggagatgggggaatgtcgaggattcgtggggtcagaattcactagcatctgtcttacccaaagccttttggatctttcggtttgaaacgccggtccctgttcccctcaattttgatactaaagttcagacacaaaactgaagtgttgaaactcatagattggatggggtgcctctgaatttaggtgtacttgcgtttattgagaaacatgtatgccaggtgaggctctgtacatatttaacgcaaacttcagcatcctttaaattttaaaggagaatatatttaacctcagtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctac

SEQ ID NO: 420019 - DNA, 2744 bp, Homo sapiens
gaatcacactcaggcagtctctctcctttctgaacagagatgagccctaagatacctggaagattttgtttttaacctcacattaaggaaagcacacatcaccttgaaagagctaaacttgacgtcctacagaatttctctaacttaacatgttgagtctctgagagtgcaaaacttgaaacaagagaaagtggcctgcctggcatcctctgcttattgaatggttttatttaattctcctttacattgccaccttaacaatccttccagctacgtatcttaaaggatgtgatggagaagttatcaactggtgttttcagacctcagttggatgaacccattccactgtatgaggcaaaagtttccatggaagctgttcagaaaaatcaaggaagaaaaaaggtagtgcacatcagcgccctggatcgcatactttccagaagcgtcgctgaacctggcgactggactctggccgaggacctggcagaagcgccagggcagggtcaccgctgggacagtgggcgttgacggccacccgggatcgccgctgcgggctgcgtctcgcgggctgcccactgcgcatgctccgctcggaaccggcgggggcggaggcggggccgcgtcgggggcgggagctcggcgaggcgccacgtcaggggcgggcccggcgcgcgcgggaagtctctgtagggcggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctac

SEQ ID NO: 420020 - DNA, 2564 bp, Homo sapiens
gaatcacactcaggcagtctctctcctttctgaacagagatgagccctaagatacctggaagattttgtttttaacctcacattaaggaaagcacacatcaccttgaaagagctaaacttgacgtcctacagaatttctctaacttaacatgttgagtctctgagagtgcaaaacttgaaacaagagaaagtggcctgcctggcatcctctgcttattgaatggttttatttaattctcctttacattgccaccttaacaatccttccagctacgtatcttaaaggatgtgatggagaagttatcaactggtgttttcagacctcagttggatgaacccattccactgtatgaggcaaaagtttccatggaagctgttcagaaaaatcaaggaagaaaaaaggtagtgcacatcagcgccctggatcgcatactttccagaagcgtcgctgaacctggcgactggactctggccgaggacctggcagaagcgccagggcagggtcaccgctgggacagtgggcgttgacggccacccgggatcgccgctgcgggctgcgtctcgcgggctgcccactgcgcatgctccgctcggaaccggcgggggcggaggcggggccgcgtcgggggcgggagctcggcgaggcgccacgtcaggggcgggcccggcgcgcgcgggaagtctctgtagggcggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactgggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctac

SEQ ID NO: 420021 - DNA, 3714 bp, Homo sapiens
  misc_feature (3190)..(3190): n is a, c, g, or t
  misc_feature (3247)..(3247): n is a, c, g, or t
gaatcacactcaggcagtctctctcctttctgaacagagatgagccctaagatacctggaagattttgtttttaacctcacattaaggaaagcacacatcaccttgaaagagctaaacttgacgtcctacagaatttctctaacttaacatgttgagtctctgagagtgcaaaacttgaaacaagagaaagtggcctgcctggcatcctctgcttattgaatggttttatttaattctcctttacattgccaccttaacaatccttccagctacgtatcttaaaggatgtgatggagaagttatcaactggtgttttcagacctcagttggatgaacccattccactgtatgaggcaaaagtttccatggaagctgttcagaaaaatcaaggaagaaaaaaggtagtgcacatcagcgccctggatcgcatactttccagaagcgtcgctgaacctggcgactggactctggccgaggacctggcagaagcgccagggcagggtcaccgctgggacagtgggcgttgacggccacccgggatcgccgctgcgggctgcgtctcgcgggctgcccactgcgcatgctccgctcggaaccggcgggggcggaggcggggccgcgtcgggggcgggagctcggcgaggcgccacgtcaggggcgggcccggcgcgcgcgggaagtctctgtagggcggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtaaaaaaaaaaaaaaaaaaaaaaaaaaaaaaaaagagagagagagagagagaagagagagaaagaaaaaaaaaaaagagaaaagaaaaaaaaaaagaaaaaagaaagaaaagaaaaaaaaagagagagagagagagacgaaaagaagagagagagagcgagaaagcgcgagagaaagaagacgaacgaaaagaaaaagaacacacaaaacaaaacaacacacgacagaaacacaccgcacacacaggagacaccacaaaaataaacgcaaacaaaagcggaaaaaaaacaggagccagaactagcagaggcaacacaacaaacaaaaaaagcacacaaaaaaaactgacctagatatgtagcattaatgcattttctacttaccagaattttacaaactctgatgttatcaacattgaaatggccggaatcaggaaaaatagatactgttaagaaaatgagacatatcaaaagattattttgggacaacagagaaagtatctagtcatgttaaaggtatttttattttggatcttttcatttactgatatttacttaccgcatgcctgagcaataagcttggccagaaatacttcattaccatattgtttactcattatggaggtacgaagtagagatgagacttcatcnatatctcgaaggttttttgcagaacaacataccaaattaggaagaatctcatgagcntttctgcaggctatttcataaccttctatgacctctgaaactgacaggccaatcctcagaagttcttcaggctaattccaggagagctccagcaaataccagaacaaagtttgtgccatctccaacttctggctcttgcatatgagaagccattacaatcatttttgcagcaggatgctgtacttctagttctctttatatagttgctgcatcgtttgtcacaaacaacttctccaagtggttgataaccattttgttcattccatttggtccatatgctgtacgagtggtttgggcaagctccttgcaagcttgtatgtttctatacacagcctcttctaatcctgaaaagtgtttcgctccctccttgagcatctgggcaaagcccaggagccttgggaacgtgaagcagccatggccagcctgcaggaagcagttcacgcgaccgctcggacccacgcgtcacg

SEQ ID NO: 420022 - DNA, 2887 bp, Homo sapiens
gaatcacactcaggcagtctctctcctttctgaacagagatgagccctaagatacctggaagattttgtttttaacctcacattaaggaaagcacacatcaccttgaaagagctaaacttgacgtcctacagaatttctctaacttaacatgttgagtctctgagagtgcaaaacttgaaacaagagaaagtggcctgcctggcatcctctgcttattgaatggttttatttaattctcctttacattgccaccttaacaatccttccagctacgtatcttaaaggatgtgatggagaagttatcaactggtgttttcagacctcagttggatgaacccattccactgtatgaggcaaaagtttccatggaagctgttcagaaaaatcaaggaagaaaaaaggtagtgcacatcagcgccctggatcgcatactttccagaagcgtcgctgaacctggcgactggactctggccgaggacctggcagaagcgccagggcagggtcaccgctgggacagtgggcgttgacggccacccgggatcgccgctgcgggctgcgtctcgcgggctgcccactgcgcatgctccgctcggaaccggcgggggcggaggcggggccgcgtcgggggcgggagctcggcgaggcgccacgtcaggggcgggcccggcgcgcgcgggaagtctctgtagggcggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaaatctccatcaaagcagacacaggatgtttgcctgcaggggggagaaatacccagttttaaattatttccaccaacttctgcaacaaataatgaattcaaggtgggattagggtaagaggaaattcaaaaacgtgctctcacctgacagatctttcattgcagcagagaagttcccagacctcttgtgctctttctcctactgcaacaagacctttaaaaaaaaattgttcactaaataaatttcaaagcaccactttaaaacaaagatccctctgtaggagtctgaacctcaaaatgtatgccttcaaataaaatcagcagattcctagtacactcgatttctctatcaatcttctctttcttctcttttactgtttttcagcatataaatttatatttaatattcatagatcttggtatgagaaattgtaataaataccaaatgtaaacagaaaac

SEQ ID NO: 420023 - DNA, 2845 bp, Homo sapiens
gaatcacactcaggcagtctctctcctttctgaacagagatgagccctaagatacctggaagattttgtttttaacctcacattaaggaaagcacacatcaccttgaaagagctaaacttgacgtcctacagaatttctctaacttaacatgttgagtctctgagagtgcaaaacttgaaacaagagaaagtggcctgcctggcatcctctgcttattgaatggttttatttaattctcctttacattgccaccttaacaatccttccagctacgtatcttaaaggatgtgatggagaagttatcaactggtgttttcagacctcagttggatgaacccattccactgtatgaggcaaaagtttccatggaagctgttcagaaaaatcaaggaagaaaaaaggtagtgcacatcagcgccctggatcgcatactttccagaagcgtcgctgaacctggcgactggactctggccgaggacctggcagaagcgccagggcagggtcaccgctgggacagtgggcgttgacggccacccgggatcgccgctgcgggctgcgtctcgcgggctgcccactgcgcatgctccgctcggaaccggcgggggcggaggcggggccgcgtcgggggcgggagctcggcgaggcgccacgtcaggggcgggcccggcgcgcgcgggaagtctctgtagggcggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacagagccttatctattggctccaccctgctttgtcttggctaccactgttccctcgtattggagctgatagaaaaatggctggaaagacaagtccttggtcaaatgatgcaaccctgcagcatgttttaatgagtgactggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaaatctccatcaaagcagacacaggatgtttgcctgcaggggggagaaatacccagttttaaattatttccaccaacttctgcaacaaataatgaattcaaggtgggattagggtaagaggaaattcaaaaacgtgctctcacctgacagatctttcattgcagcagagaagttcccagacctcttgtgctctttctcctactgcaacaagacctttaaaaaaaaattgttcactaaataaatttcaaagcaccactttaaaacaaagatccctctgtaggagtctgaacctcaaaatgtatgccttcaaataaaatcagcagattcctagtacactcgatttctctatcaatcttctctttcttctcttttactgtttttcagcatataaatttatatttaatattcatagatcttggtatgagaaattgtaataaataccaaatgtaaacagaaaac

SEQ ID NO: 420024 - DNA, 527 bp, Homo sapiens
agacaaactaactgaagccacagccggaagcaggctgaccacaagtgctaaggttctggttagttcttttctaggttcaaaagaagaggctgttctaagaaagactaccgagtaatcaatcacctcctcagagaaagtctgctcaggaaactctcctcccaccagcccctgcacttggttccttgcgttgcctctggctggaagctgttgtccccaacttcagaaagtgtctgcagatttcacaggctctctcttgggtcaaggattgatcaaataaatatatcacggataatgggagctggattcctcactgcctgagaaaagaacacaaatagagaaagggagaaagaataaaccctgtaatgctgaaatggaattaaagggaccagctctgtgaacacggcaagtaacaacagagagaaaacgtgaggagaaaagagagaccgggattttgaaatcctgtttcctgaatgccatctcaccaggcacacgaaagaataaaattaaggaatcaagagccaagaatt

SEQ ID NO: 420025 - DNA, 1128 bp, Homo sapiens
attacatgcctcctgatacgatgcaatgagaagaacacaacagcatgtctttgatattcctgtggaaaatacataccctcaatcttaccatgagcaaacatcagacaaactcaaatcaagggacattctacaaaataattgacctacattcttcaacagtgtcagcggaggctcacgaggcatggtgactgaagccccgcaggaggtgggatttgcaaaggacattattggaatgaagggtgaaatttgaataaggtctgtagatgagataacagtattggatctgttttaatttcccaattttgataattatactgtagatacacaagagaatgttcttgtttttaggaaatgtgtactaaaatatttagggataagaaagcatcactgtcagccactcacattagaaaatgtgtgtgtgtgtgtgtgtgtgtgtgtgtataaagcaaatgagataaaatattaatatttggggattctgggtgaagaatatatagaaattctttggatagtcatgtcttttctataactctgaaattatgccaaagcaaaaagcttaaaaaggttttaagggggcaaaaagcaaagaatttaagtctttaattggaaactgatctttttttttagcatacataccactaggaaatttatatatttagtagctatattatgaataatcctgaaatgattactcagctccccagattcctccatgattagtttacatttacaaatattttcctgtagttatactgaaaatgatttgtttggtgtccatgcacctcttttacgtagccgttcactacttctcctcccgtgcctatagtgtgccaggttctagctaggagtgttacatacgctgtctctcataattctcacaataatgcagagaaggacatgttattgtacccattttacagatgaagaaagaaggattaaagatgttaaatgactaaatgatgttacacagttagttaagtggtagaagctcagtcagaacccaggtctgtaaatacttcccagcagaataaaggccaaggagagcctcactcacggcagagggtagaagagtcaagacgaagcagcagccggtgccccctcccgcataactgggcaggcaccccgccc

SEQ ID NO: 420026 - DNA, 337 bp, Homo sapiens
ctctttgaagatggggtcaggccacaagccaaggaacggaggcagcctcttgaacctgaaaaaggcaagaaaatggattctcccctagtgccttcagaaggaacgtggacaagcagaactgttcaaaagaagaggctgttctaagaaagactaccgagtaatcaatcacctcctcagagaaagtctgctcagggaccagctctgtgaacacggcaagtaacaacagagagaaaacgtgaggagaaaagagagaccgggattttgaaatcctgtttcctgaatgccatctcaccaggcacacgaaagaataaaattaaggaatcaagagccaagaatt

SEQ ID NO: 420027 - DNA, 583 bp, Homo sapiens
ctctttgaagatggggtcaggccacaagccaaggaacggaggcagcctcttgaacctgaaaaaggcaagaaaatggattctcccctagtgccttcagaaggaacgtggacaagcagaactgtaagataataaatttgtgttgttttacgcctttaagtttttggtaatttgttacagcaacagtgggaaactagtgcagcatacctacaggactgttccatttgtaagttctaaaacacaggcaactgattatttttatttaaatcaggagcacaaatcattttaagtttcactgccagtgctaccttgctctctagtgagcaggtttttgacccttgccctcctgcccaactctgtgaaatacttagttgaaaaagtgtgcacactgaatgtgctaaaaagggtaaaagtaccgtgagtcaacccaaacattagcagtcctgggtgtgtgggctgtgggccacctgcacaccatcgccattgtatgtttgcaccaccatttgtttattcatttactagctgatggacatttggtttgtttccagtttgaggtgatatcaataaaggtgtttataatttgcat

SEQ ID NO: 420028 - DNA, 374 bp, Homo sapiens
agcaaacaggggttcctggaaaagagaggtgtctggatcagtctgggtcccttgcgaccctttggtctgcggagcctggggcacagctcaagtgagacctcatctacttgggtagaaattaaattgggcattcaacttttaaactgaaaactgcatctcttttcatgtcccctgtctcaattgcgacttctccaagtgtggtgtgacacagccaggagggatattcactggaccagctctgtgaacacggcaagtaacaacagagagaaaacgtgaggagaaaagagagaccgggattttgaaatcctgtttcctgaatgccatctcaccaggcacacgaaagaataaaattaaggaatcaagagccaagaatt

SEQ ID NO: 420029 - DNA, 348 bp, Homo sapiens
gcaatggacccagctcacgggagcttgcagtctaacacaggaaacagccacctgcatctgtaaaggtactgatgagacctctttagtatgacactggcaactgacggcactgcggatatgtttggaataaggttcaaaagaagaggctgttctaagaaagactaccgagtaatcaatcacctcctcagagaaagtctgctcagggaccagctctgtgaacacggcaagtaacaacagagagaaaacgtgaggagaaaagagagaccgggattttgaaatcctgtttcctgaatgccatctcaccaggcacacgaaagaataaaattaaggaatcaagagccaagaatt

SEQ ID NO: 420030 - DNA, 378 bp, Homo sapiens
agacgccccatgatggctgtgtgaattttcaggctcatttcgtggctccggtcactgctgccaccatcttttcccccaaacctaggtccttactcttatctaatcatgatctgcaggaaactctcctcccaccagcccctgcacttggttccttgcgttgcctctggctggaagctgttgtccccaacttcagaaagtgtctgcagatttcacaggctctctcttgggtcaagggaccagctctgtgaacacggcaagtaacaacagagagaaaacgtgaggagaaaagagagaccgggattttgaaatcctgtttcctgaatgccatctcaccaggcacacgaaagaataaaattaaggaatcaagagccaagaatt

SEQ ID NO: 420031 - DNA, 400 bp, Homo sapiens
attacatgcctcctgatacgatgcaatgagaagaacacaacagcatgtctttgatattcctgtggaaaatacataccctcaatcttaccatgagcaaacatcagacaaactcaaatcaagggacattctacaaaataattgacctacattcttcaacagtgtcagcggaggctcacgaggcatggtgactgaagccccgcaggaggtgggatttgcaaaggacattattggaatgaagggtgaaatttgaataagggaccagctctgtgaacacggcaagtaacaacagagagaaaacgtgaggagaaaagagagaccgggattttgaaatcctgtttcctgaatgccatctcaccaggcacacgaaagaataaaattaaggaatcaagagccaagaatt

SEQ ID NO: 420032 - DNA, 465 bp, Homo sapiens
gcaatggacccagctcacgggagcttgcagtctaacacaggaaacagccacctgcatctgtaaaggtactgatgagacctctttagtatgacactggcaactgacggcactgcggatatgtttggaataaggttcaaaagaagaggctgttctaagaaagactaccgagtaatcaatcacctcctcagagaaagtctgctcaggaaactctcctcccaccagcccctgcacttggttccttgcgttgcctctggctggaagctgttgtccccaacttcagaaagtgtctgcagatttcacaggctctctcttgggtcaagggaccagctctgtgaacacggcaagtaacaacagagagaaaacgtgaggagaaaagagagaccgggattttgaaatcctgtttcctgaatgccatctcaccaggcacacgaaagaataaaattaaggaatcaagagccaagaatt

SEQ ID NO: 420033 - DNA, 410 bp, Homo sapiens
agacaaactaactgaagccacagccggaagcaggctgaccacaagtgctaaggttctggttagttcttttctaggttcaaaagaagaggctgttctaagaaagactaccgagtaatcaatcacctcctcagagaaagtctgctcaggaaactctcctcccaccagcccctgcacttggttccttgcgttgcctctggctggaagctgttgtccccaacttcagaaagtgtctgcagatttcacaggctctctcttgggtcaagcaccaactgctgtgtactacgccatcgtatctacgagagagatggggtccaggaccccccatagagctggacggtatcatacatgttcatagtgaccaatgatgcgcctatccccaactaaaaaataaacgcagagtgcgtcctgag

SEQ ID NO: 420034 - DNA, 291 bp, Homo sapiens
ccttcccctcgggattaatttacctctttggacggcttcctgagtacatctcctactccacccccgctccgcagcccgtgactcagcacagtgacaatgcacatcagcagcgtctcacatgtgtgctctttatcctgttccgtctcttctgcagggaccagctctgtgaacacggcaagtaacaacagagagaaaacgtgaggagaaaagagagaccgggattttgaaatcctgtttcctgaatgccatctcaccaggcacacgaaagaataaaattaaggaatcaagagc

SEQ ID NO: 420035 - DNA, 1659 bp, Homo sapiens
tcctctgctgggcctgggggtctgggccagcaacaagttagtattgcagacatgggccaaggagccagaggccatgcagtggctcagggtccgtgagtcgcctggggaggccacaggacacagggtcaccatggggacagccgccctgggtcccgtctgggcagcgctcctgctctttctcctgatgtgtgagatccctatggtggagctcacctttgacagagctgtggccagcggctgccaacggtgctgtgactctgaggaccccctggatcctgcccatgtatcctcagcctcttcctccggccgcccccacgccctgcctgagatcagaccctacattaatatcaccatcctgaagggtgacaaaggggacccaggcccaatgggcctgccagggtacatgggcagggagggtccccaaggggagcctggccctcagggcagcaagggtgacaagggggagatgggcagccccggcgccccgtgccagaagcgcttcttcgccttctcagtgggccgcaagacggccctgcacagcggcgaggacttccagacgctgctcttcgaaagggtctttgtgaaccttgatgggtgctttgacatggcgaccggccagtttgctgctcccctgcgtggcatctacttcttcagcctcaatgtgcacagctggaattacaaggagacgtacgtgcacattatgcataaccagaaagaggctgtcatcctgtacgcgcagcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggccaccctcccggctggagagctcagctgatacggcatcctgcgagaagacctgccctcctcactgggatccccttcctgcctcctcccagggctctgccagggccttgctcagtcccttccaccaaagtcatctgaacttccgtttccccagggcctccagctgccctcagacactgatgtctgtccccaggtgctctctgcccctcatgcccctctcaccggcccagtgccccgactctccaggctttatcaaggtgctaaggcccgggtgggcagctcctcgtctcagagccctcctccggcctggtgctgcctttacaaacacctgcaggagaagggccacggaagccccaggctttagagccctcagcaggtctggggagctagagcaaaggagggacctcaggccttccgtttcttcttccagggtggggtggcctggtgttcccctagccttccaaacccaggtggcctgcccttctccccagagggaggcggcctccgcccattggtgctcatgcagactctggggctgaggtgccccggggggtgatctctggtgctcacagccgagggagccgtggctccatggccagatgacggaaacagggtctgaccaagtgccaggaagacctgtgctataaaccaccctgcctgatcctgcccctgcctgaccccgccacgccctgccgtccagcatgattaaagaatgctgtctcctcttggaaaaaaaaaaa

SEQ ID NO: 420036 - DNA, 486 bp, Homo sapiens
gggagggaaaatactgaagtgtaatattccagagttctctcttgtctgctctgactcctgccagctgccctgcacctagagggacaggaggctcttctccggggcattgcatggccgggagccaaatgagctggcaccagaacctgtgaaccacgaagggacgataccagaaaacaccctcaacccaaaggaaatagactacagccccaattggctgactttggctatagaaaaaagaaaggaacgaaaagagacagttttttttggaaagctaagtcttccctttatcgagtcaagaaacccccccttcttgagctatttacagcttttaacaattgagtaaagtacgctccggacacaattggagaaactggttatttaacaagggtttgactcgagtggcatgctttcaaatataaacagacttctttaaggaattaaagttgactaatagagccaataaaagcctcttggaaaaactggtct

SEQ ID NO: 420037 - DNA, 2133 bp, Homo sapiens
acactaattataatgcattagcatgctaaaagacactcccaccagcaccatgacaatttacaaatgccatggcaatgtccagaaattaccttatacggtctaaaagcgggaggaactctcagttctggggaaatctcccctttcttggaaaactgattaataatccaccctttgtttagcatataatcaagaaataaccataaaaacagccaaccagcagcgctcaggggtggtctgtctatggagtagccattcttttgtttctttacttctctgtaaacttgctttgacttcactctgtggactcacctcaaattctttcttgtgcgagtccaggaaccctctctttgggtctggattgggacccctttccagtaccattttttctagtgaaccacgaagggacgataccagaaaacaccctcaacccaaaggaaatagactacagccccaattggctgactttggctatagaaaaaagaaaggaacgaaaagagacagttttttttggaaagctaagtcttccctttatcgagtcaagaaacccccccttcttgagctatttacagcttttaacaattgagtaaagtacgctccggtcaccatggggacagccgccctgggtcccgtctgggcagcgctcctgctctttctcctgatgtgtgagatccctatggtggagctcacctttgacagagctgtggccagcggctgccaacggtgctgtgactctgaggaccccctggatcctgcccatgtatcctcagcctcttcctccggccgcccccacgccctgcctgagatcagaccctacattaatatcaccatcctgaagggtgacaaaggggacccaggcccaatgggcctgccagggtacatgggcagggagggtccccaaggggagcctggccctcagggcagcaagggtgacaagggggagatgggcagccccggcgccccgtgccagaagcgcttcttcgccttctcagtgggccgcaagacggccctgcacagcggcgaggacttccagacgctgctcttcgaaagggtctttgtgaaccttgatgggtgctttgacatggcgaccggccagtttgctgctcccctgcgtggcatctacttcttcagcctcaatgtgcacagctggaattacaaggagacgtacgtgcacattatgcataaccagaaagaggctgtcatcctgtacgcgcagcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggccaccctcccggctggagagctcagctgatacggcatcctgcgagaagacctgccctcctcactgggatccccttcctgcctcctcccagggctctgccagggccttgctcagtcccttccaccaaagtcatctgaacttccgtttccccagggcctccagctgccctcagacactgatgtctgtccccaggtgctctctgcccctcatgcccctctcaccggcccagtgccccgactctccaggctttatcaaggtgctaaggcccgggtgggcagctcctcgtctcagagccctcctccggcctggtgctgcctttacaaacacctgcaggagaagggccacggaagccccaggctttagagccctcagcaggtctggggagctagagcaaaggagggacctcaggccttccgtttcttcttccagggtggggtggcctggtgttcccctagccttccaaacccaggtggcctgcccttctccccagagggaggcggcctccgcccattggtgctcatgcagactctggggctgaggtgccccggggggtgatctctggtgctcacagccgagggagccgtggctccatggccagatgacggaaacagggtctgaccaagtgccaggaagacctgtgctataaaccaccctgcctgatcctgcccctgcctgaccccgccacgccctgccgtccagcatgattaaagaatgctgtctcctcttggaaaaaaaaaaa

SEQ ID NO: 420038 - DNA, 1889 bp, Homo sapiens
gggagggaaaatactgaagtgtaatattccagagttctctcttgtctgctctgactcctgccagctgccctgcacctagagggacaggaggctcttctccggggcattgcatggccgggagccaaatgagctggcaccagaacctgtgaaccacgaagggacgataccagaaaacaccctcaacccaaaggaaatagactacagccccaattggctgactttggctatagaaaaaagaaaggaacgaaaagagacagttttttttggaaagctaagtcttccctttatcgagtcaagaaacccccccttcttgagctatttacagcttttaacaattgagtaaagtacgctccggtcaccatggggacagccgccctgggtcccgtctgggcagcgctcctgctctttctcctgatgtgtgagatccctatggtggagctcacctttgacagagctgtggccagcggctgccaacggtgctgtgactctgaggaccccctggatcctgcccatgtatcctcagcctcttcctccggccgcccccacgccctgcctgagatcagaccctacattaatatcaccatcctgaagggtgacaaaggggacccaggcccaatgggcctgccagggtacatgggcagggagggtccccaaggggagcctggccctcagggcagcaagggtgacaagggggagatgggcagccccggcgccccgtgccagaagcgcttcttcgccttctcagtgggccgcaagacggccctgcacagcggcgaggacttccagacgctgctcttcgaaagggtctttgtgaaccttgatgggtgctttgacatggcgaccggccagtttgctgctcccctgcgtggcatctacttcttcagcctcaatgtgcacagctggaattacaaggagacgtacgtgcacattatgcataaccagaaagaggctgtcatcctgtacgcgcagcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggccaccctcccggctggagagctcagctgatacggcatcctgcgagaagacctgccctcctcactgggatccccttcctgcctcctcccagggctctgccagggccttgctcagtcccttccaccaaagtcatctgaacttccgtttccccagggcctccagctgccctcagacactgatgtctgtccccaggtgctctctgcccctcatgcccctctcaccggcccagtgccccgactctccaggctttatcaaggtgctaaggcccgggtgggcagctcctcgtctcagagccctcctccggcctggtgctgcctttacaaacacctgcaggagaagggccacggaagccccaggctttagagccctcagcaggtctggggagctagagcaaaggagggacctcaggccttccgtttcttcttccagggtggggtggcctggtgttcccctagccttccaaacccaggtggcctgcccttctccccagagggaggcggcctccgcccattggtgctcatgcagactctggggctgaggtgccccggggggtgatctctggtgctcacagccgagggagccgtggctccatggccagatgacggaaacagggtctgaccaagtgccaggaagacctgtgctataaaccaccctgcctgatcctgcccctgcctgaccccgccacgccctgccgtccagcatgattaaagaatgctgtctcctcttggaaaaaaaaaaa

SEQ ID NO: 420039 - DNA, 1282 bp, Homo sapiens
tcctctgctgggcctgggggtctgggccagcaacaagttagtattgcagacatgggccaaggagccagaggccatgcagtggctcagggtccgtgagtcgcctggggaggccacaggacacagggtcaccatggggacagccgccctgggtcccgtctgggcagcgctcctgctctttctcctgatgtgtgagatccctatggtggagctcacctttgacagagctgtggccagcggctgccaacggtgctgtgactctgaggaccccctggatcctgcccatgtatcctcagcctcttcctccggccgcccccacgccctgcctgagatcagaccctacattaatatcaccatcctgaaggcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggccaccctcccggctggagagctcagctgatacggcatcctgcgagaagacctgccctcctcactgggatccccttcctgcctcctcccagggctctgccagggccttgctcagtcccttccaccaaagtcatctgaacttccgtttccccagggcctccagctgccctcagacactgatgtctgtccccaggtgctctctgcccctcatgcccctctcaccggcccagtgccccgactctccaggctttatcaaggtgctaaggcccgggtgggcagctcctcgtctcagagccctcctccggcctggtgctgcctttacaaacacctgcaggagaagggccacggaagccccaggctttagagccctcagcaggtctggggagctagagcaaaggagggacctcaggccttccgtttcttcttccagggtggggtggcctggtgttcccctagccttccaaacccaggtggcctgcccttctccccagagggaggcggcctccgcccattggtgctcatgcagactctggggctgaggtgccccggggggtgatctctggtgctcacagccgagggagccgtggctccatggccagatgacggaaacagggtctgaccaagtgccaggaagacctgtgctataaaccaccctgcctgatcctgcccctgcctgaccccgccacgccctgccgtccagcatgattaaagaatgctgtctcctcttggaaaaaaaaaaa

SEQ ID NO: 420040 - DNA, 777 bp, Homo sapiens
ggggcatttggggggtgaagtggcccccgaagaatggaacccacacccatagctctccccacagctgatacggcatcctgcgagaagacctgccctcctcactgggatccccttcctgcctcctcccagggctctgccagggccttgctcagtcccttccaccaaagtcatctgaacttccgtttccccagggcctccagctgccctcagacactgatgtctgtccccaggtgctctctgcccctcatgcccctctcaccggcccagtgccccgactctccaggctttatcaaggtgctaaggcccgggtgggcagctcctcgtctcagagccctcctccggcctggtgctgcctttacaaacacctgcaggagaagggccacggaagccccaggctttagagccctcagcaggtctggggagctagagcaaaggagggacctcaggccttccgtttcttcttccagggtggggtggcctggtgttcccctagccttccaaacccaggtggcctgcccttctccccagagggaggcggcctccgcccattggtgctcatgcagactctggggctgaggtgccccggggggtgatctctggtgctcacagccgagggagccgtggctccatggccagatgacggaaacagggtctgaccaagtgccaggaagacctgtgctataaaccaccctgcctgatcctgcccctgcctgaccccgccacgccctgccgtccagcatgattaaagaatgctgtctcctcttggaaaaaaaaaaa

SEQ ID NO: 420041 - DNA, 2623 bp, Homo sapiens
acactaattataatgcattagcatgctaaaagacactcccaccagcaccatgacaatttacaaatgccatggcaatgtccagaaattaccttatacggtctaaaagcgggaggaactctcagttctggggaaatctcccctttcttggaaaactgattaataatccaccctttgtttagcatataatcaagaaataaccataaaaacagccaaccagcagcgctcaggggtggtctgtctatggagtagccattcttttgtttctttacttctctgtaaacttgctttgacttcactctgtggactcacctcaaattctttcttgtgcgagtccaggaaccctctctttgggtctggattgggacccctttccagtaccattttttctagtgaaccacgaagggacgataccagaaaacaccctcaacccaaaggaaatagactacagccccaattggctgactttggctatagaaaaaagaaaggaacgaaaagagacagttttttttggaaagctaagtcttccctttatcgagtcaagaaacccccccttcttgagctatttacagcttttaacaattgagtaaagtacgctccggtcaccatggggacagccgccctgggtcccgtctgggcagcgctcctgctctttctcctgatgtgtgagatccctatggtggagctcacctttgacagagctgtggccagcggctgccaacggtgctgtgactctgaggaccccctggatcctgcccatgtatcctcagcctcttcctccggccgcccccacgccctgcctgagatcagaccctacattaatatcaccatcctgaagggtgacaaaggggacccaggcccaatgggcctgccagggtacatgggcagggagggtccccaaggggagcctggccctcagggcagcaagggtgacaagggggagatgggcagccccggcgccccgtgccagaagcgcttcttcgccttctcagtgggccgcaagacggccctgcacagcggcgaggacttccagacgctgctcttcgaaagggtctttgtgaaccttgatgggtgctttgacatggcgaccggccagtttgctgctcccctgcgtggcatctacttcttcagcctcaatgtgcacagctggaattacaaggagacgtacgtgcacattatgcataaccagaaagaggctgtcatcctgtacgcgcagcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggccaccctcccggctggagagctcaggtgctggtcccgtcccctgcagggctcagtttgcactgctgtgaagcaggaaggccagggaggtccccggggacctggcattctggggagaccctgcttctatcttggctgccatcatccctcccagcctatttctgctcctctcttctctcttggacctattttaagaagcttgctaacctaaatattctagaactttcccagcctcgtagcccagcacttctcaaacttggaaatgcatgcgaatcacccggggttcgtgttaaatgcagattctgactcagcaggtctgagtgggtccaggattctgtgtttctcatatgttcctgggtgatgctgatggggtcagtctatgaaccacactggagcaaccaggttctaggactttctcaatattctagtactttctgaacattctggaatcctccccacattctagaattctcccaacatttttttttcttgagacagagtcttgctctgttgcccaggctagagtgcagtggtgcaatctcagttcactgcaacctctgcctcccgggttcaagcgattcttctgcctcagcctccctagtggctgggattacaggcgcctgctaccatgcctggctaatttttgtatttttagtagagatggggtttcaccatattggccaggctggtcttgaactcctgacttcaggtgacccacccgcctcggcctctcaaaatgctgggattacaggtgtgagccaccgtgcctggccaattccaacattcttaaattctctcatccctccagggctccccgtgctatgttctctttaccccttccccctcttctcttgctcaggcctgcaccactgcagccaccgttcatttattcattcattaaacactgagcactcactctgtgctgggtcccgggaagggtgagggggtcagacacaggccctgcccctgccctcagtgactggccagtccagcccaggcggggagagatgtgtacataggttttaaagcagacccagagctcatgggggcctgtgttctgggtgttcaggtgctgctggtcctccattacccactgctccccaaggctggtgggacggggtcccggtggcaggggcaggtatctccttcccgttcctcatccacctgcccagtgctcatcgttacagcaaaccccagggggccttggccaggtcaagggttctgtgagga

SEQ ID NO: 420042 - DNA, 1986 bp, Homo sapiens
  misc_feature (1978)..(1978): n is a, c, g, or t
  misc_feature (1980)..(1980): n is a, c, g, or t
acactaattataatgcattagcatgctaaaagacactcccaccagcaccatgacaatttacaaatgccatggcaatgtccagaaattaccttatacggtctaaaagcgggaggaactctcagttctggggaaatctcccctttcttggaaaactgattaataatccaccctttgtttagcatataatcaagaaataaccataaaaacagccaaccagcagcgctcaggggtggtctgtctatggagtagccattcttttgtttctttacttctctgtaaacttgctttgacttcactctgtggactcacctcaaattctttcttgtgcgagtccaggaaccctctctttgggtctggattgggacccctttccagtaccattttttctagtgaaccacgaagggacgataccagaaaacaccctcaacccaaaggaaatagactacagccccaattggctgactttggctatagaaaaaagaaaggaacgaaaagagacagttttttttggaaagctaagtcttccctttatcgagtcaagaaacccccccttcttgagctatttacagcttttaacaattgagtaaagtacgctccggtcaccatggggacagccgccctgggtcccgtctgggcagcgctcctgctctttctcctgatgtgtgagatccctatggtggagctcacctttgacagagctgtggccagcggctgccaacggtgctgtgactctgaggaccccctggatcctgcccatgtatcctcagcctcttcctccggccgcccccacgccctgcctgagatcagaccctacattaatatcaccatcctgaagggtgacaaaggggacccaggcccaatgggcctgccagggtacatgggcagggagggtccccaaggggagcctggccctcagggcagcaagggtgacaagggggagatgggcagccccggcgccccgtgccagaagcgcttcttcgccttctcagtgggccgcaagacggccctgcacagcggcgaggacttccagacgctgctcttcgaaagggtctttgtgaaccttgatgggtgctttgacatggcgaccggccagtttgctgctcccctgcgtggcatctacttcttcagcctcaatgtgcacagctggaattacaaggagacgtacgtgcacattatgcataaccagaaagaggctgtcatcctgtacgcgcagcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggccaccctcccggctggagagctcaggtgctggtcccgtcccctgcagggctcagtttgcactgctgtgaagcaggaaggccagggaggtccccggggacctggcattctggggagaccctgcttctatcttggctgccatcatccctcccagcctatttctgctcctctcttctctcttggacctattttaagaagcttgctaacctaaatattctagaactttcccagcctcgtagcccagcacttctcaaacttggaaatgcatgcgaatcacccggggttcgtgttaaatgcagattctgactcagcaggtctgagtgggtccaggattctgtgtttctcatatgttcctgggtgatgctgatggggtcagtctatgaaccacactggagcaaccaggttctaggactttctcaatattctagtactttctgaacattctggaatcctccccacattctagaattctcccaactactagggaggctgaggcaggagaatcgcttgagcacaggaggcgttggctgcagtgagccaagatcacgccactgcactccagcctgggtaacaagagcgaaactngngtccaa

SEQ ID NO: 420043 - DNA, 1579 bp, Homo sapiens
acactaattataatgcattagcatgctaaaagacactcccaccagcaccatgacaatttacaaatgccatggcaatgtccagaaattaccttatacggtctaaaagcgggaggaactctcagttctggggaaatctcccctttcttggaaaactgattaataatccaccctttgtttagcatataatcaagaaataaccataaaaacagccaaccagcagcgctcaggggtggtctgtctatggagtagccattcttttgtttctttacttctctgtaaacttgctttgacttcactctgtggactcacctcaaattctttcttgtgcgagtccaggaaccctctctttgggtctggattgggacccctttccagtaccattttttctagtgaaccacgaagggacgataccagaaaacaccctcaacccaaaggaaatagactacagccccaattggctgactttggctatagaaaaaagaaaggaacgaaaagagacagttttttttggaaagctaagtcttccctttatcgagtcaagaaacccccccttcttgagctatttacagcttttaacaattgagtaaagtacgctccggtcaccatggggacagccgccctgggtcccgtctgggcagcgctcctgctctttctcctgatgtgtgagatccctatggtggagctcacctttgacagagctgtggccagcggctgccaacggtgctgtgactctgaggaccccctggatcctgcccatgtatcctcagcctcttcctccggccgcccccacgccctgcctgagatcagaccctacattaatatcaccatcctgaagggtgacaaaggggacccaggcccaatgggcctgccagggtacatgggcagggagggtccccaaggggagcctggccctcagggcagcaagggtgacaagggggagatgggcagccccggcgccccgtgccagaagcgcttcttcgccttctcagtgggccgcaagacggccctgcacagcggcgaggacttccagacgctgctcttcgaaagggtctttgtgaaccttgatgggtgctttgacatggcgaccggccagtttgctgctcccctgcgtggcatctacttcttcagcctcaatgtgcacagctggaattacaaggagacgtacgtgcacattatgcataaccagaaagaggctgtcatcctgtacgcgcagcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggccaccctcccggctggagagctcaggtgctggtcccgtcccctgcagggctcagtttgcactgctgtgaagcaggaagacctgtgctataaaccaccctgcctgatcctgcccctgcctgaccccgccacgccctgccgtccagcatgattaaagaatgctgtctcctcttggaaaaaaaaaaa

SEQ ID NO: 420044 - DNA, 1503 bp, Homo sapiens
acactaattataatgcattagcatgctaaaagacactcccaccagcaccatgacaatttacaaatgccatggcaatgtccagaaattaccttatacggtctaaaagcgggaggaactctcagttctggggaaatctcccctttcttggaaaactgattaataatccaccctttgtttagcatataatcaagaaataaccataaaaacagccaaccagcagcgctcaggggtggtctgtctatggagtagccattcttttgtttctttacttctctgtaaacttgctttgacttcactctgtggactcacctcaaattctttcttgtgcgagtccaggaaccctctctttgggtctggattgggacccctttccagtaccattttttctagtgaaccacgaagggacgataccagaaaacaccctcaacccaaaggaaatagactacagccccaattggctgactttggctatagaaaaaagaaaggaacgaaaagagacagttttttttggaaagctaagtcttccctttatcgagtcaagaaacccccccttcttgagctatttacagcttttaacaattgagtaaagtacgctccggtcaccatggggacagccgccctgggtcccgtctgggcagcgctcctgctctttctcctgatgtgtgagatccctatggtggagctcacctttgacagagctgtggccagcggctgccaacggtgctgtgactctgaggaccccctggatcctgcccatgtatcctcagcctcttcctccggccgcccccacgccctgcctgagatcagaccctacattaatatcaccatcctgaagggtgacaaaggggacccaggcccaatgggcctgccagggtacatgggcagggagggtccccaaggggagcctggccctcagggcagcaagggtgacaagggggagatgggcagccccggcgccccgtgccagaagcgcttcttcgccttctcagtgggccgcaagacggccctgcacagcggcgaggacttccagacgctgctcttcgaaagggtctttgtgaaccttgatgggtgctttgacatggcgaccggccagtttgctgctcccctgcgtggcatctacttcttcagcctcaatgtgcacagctggaattacaaggagacgtacgtgcacattatgcataaccagaaagaggctgtcatcctgtacgcgcagcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggccaccctcccggctggagagctcagctgatcctgcccctgcctgaccccgccacgccctgccgtccagcatgattaaagaatgctgtctcctcttggaaaaaaaaaaa

SEQ ID NO: 420045 - DNA, 987 bp, Homo sapiens
  misc_feature (31)..(31): n is a, c, g, or t
  misc_feature (36)..(36): n is a, c, g, or t
gggggtggggagattgattgcgttcgctagnagccncacctctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgctcacctagtggccaggaggtgcgctctgtctggttgagagc

SEQ ID NO: 420046 - DNA, 1684 bp, Homo sapiens
gggttcacaataagggcttcattgcatggactctgacctcttgtgctccttttgggctcattctaattgacaggccatttgtagctctgagctgtctagccccttcaccctcatatttggcaaaaatgtctttccagcatttattggcatcagcctttttcttcacctgagactcagcatttctgggctagcaagctctttgcatttgccagacaccccttagaaccctggtgaaagaaaggagccaatctccatgccaccctggcctgccccatgggcagccttctcggcccttttctccaactaaaaacagtaatcgtccctaggtgatttgtcattctttttaacatggatttttttttagttttaccccacccaaagcaccatgcttcatgctggaaggaataatgaagaggaaagagaaaccagaaatggtccctgctccctggaagctgtagtcgatggggggaagggtagataaatcaggcgaggacaggctggctcctggaggcatactccagcctcctgctctgagggccactgccagcaggatccagggagtggccagaaaaggggcagcagtggcgctgagccccgagcccaggcactgctacggtcacccttggttactcggtgattgattgatagggctgcatctgtcctctcactggtggttgcctgcctgtccctttggtagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgggggtgccagggagctgggttggctggcatttatctctgttgaggctggagattcctgaaactgatgtatgttaaagccacagagatagagctgaggagtcctgtgttcccccgcaaggagcaccccgggatcattttctaggttcatttctctggaacatttgctgtagcatctggtctcacggacttggctcatggtcttccagggtttttatcctggctgtctatgaactagggttttctcctgccttaggaaaaatactgcatcttctggaatctagaaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgctcacctagtggccaggaggtgcgctctgtctggttgagagc

SEQ ID NO: 420047 - DNA, 1247 bp, Homo sapiens
gccgggggtggcgggggcaggaacttctacctccctgctcagagccaagaagtcaatttgaacctttgctggggctcggtattaacacgttctgccttggagggcaagccggtggggccaggaataagcattccttttaacaacttcagttgaaaagcagccaccgccccacccgctgctgtccctggctctcatcaggtgaattcagcattcctgccaccctgccagtgcctctgtgatcctgggcatgagttgaccactatgtacctcagtttacccatccacaaaaaatgcaaaaggccaggactaagcatgggggcgtgacgtgaactcccgctcctcctctggtcaagggcttcatgcttagaggaaaccagataagccctattgcaaccccacctggagtggagtgggggaggatgaggaggagggggagaccctaccttccacaggcccagggactcgaggggtggggctccattaggagatcagtcggggcatggtgaaggggaggagaggttgtcaaggctcagctgcctggacagagaggatggaaatactccctgtgtgaaaaaagaaaaggaaaagaccccagatcaggaggcaggaaatgcagtttggcagagttggttgatgccacttacttctggacaagaagactggaggcttggccacccttgatggaaattgcagcagaaccatctctctattctgttgattcccgcaccaggctggcaaatagcttttgtcttttctgcttccttgttgcaaaagggtacaaaagcctcccacccaccccacccccaatcgccctttgtgccattatctttcaaggtgacttagcttttgaagtccctgccatctgctctgcaggcctgtactttgcaggatgtgagagcaccgcgttcccagaatgccttctgttctacccgacgtggctactgatagctctgcctgtgaggggaaaagaaagctgcgctgtggcccccttaaagcccagtccctgctgtctccctcaaaaagccacttaggaaagccacggccttgaggtaccaagagagttctttgagaaatgagagtggaaactgtgagagaggctgctctgcagtcgagtgctgggcacgtctgacgatgcctgggagaggaaaaaattccatcaaaaaactaccatggttttctttagaggaacatatgtgcacttttggcaaaacatgccttctcaggagagctggaatagttggaaccaa

SEQ ID NO: 420048 - DNA, 856 bp, Homo sapiens
gcgacagagtgagactccgtctcggaaaaaaaaaaaacatatctcactgtgtcggggcttcctggccactgtgttataatggtgcttaagtactctgcacacttccgtttactcctttaagagctgagtgctgcacctgtgctgctctcggtgctggagacacagcgctggccaggcagagaaggccctcattgtcaagtgggggagacaggggcagatcctgcctcgggttggatgctgtagagttcctgagaaccacgtgtgtgtgtttcccacccagtgcgccctatccactcctccacatccagccctaccatctccatccacgaggtgggccataccggagtcaccaaaactgagaggagtggcattaacagactgaggagtgaaatgaaacaggtaagaacacctcagtggcagcgagggatgagtggtggtctccctacctgggcttaccccagaaagcgacagaaacctagggcatgaggctgcagcccactgtctgtagagtgggaggtcccttctgtctgggatctgaacacacccctgtccccagatagatattccagagccggtcatgcgcacccttacccactcatccttaaccttaacgtgatgttctcatgaacgttccagaaaatacccttgtccatgtttgcctctgttcccgagaaccactcttaggagtgggccacagccattgaaaaagtagagtcatgcaaaaagtcaccgaatcatctgtgtccttcaaacgaaatagcaagagggctctggaaatagaccagaatgcccatgatacttggattctccaccagccacaggggtctcttttcttagttcacctttaattcctggt

SEQ ID NO: 420049 - DNA, 358 bp, Homo sapiens
cctagttttagaagtttccatagcatgaaaaatctcctgcaccatattctaagtgggaaagagtttggcgttgaaagaagtgatacgaggtctcaccatgctgcccaggctggtcttgaactcctgggctcaagcagtcttcccacctcggcctcccaaagtgctgggattacaggtgtgagccaccgtgcctggcctcggtgcgccctatccactcctccacatccagccctaccatctccatccacgaggtgggccataccggagtcaccaaaactgagaggagtggcattaacagactgaggagtgaaatgaaacagatgactaggcggtttagtgctattgaaagttctaaaag

SEQ ID NO: 420050 - DNA, 5881 bp, Homo sapiens
tcctcccttggtagccactcttgtgacaggaaggccttcttcccagccggtgaagggtcacagtgtcgttaatgttcaaagtgtagcactcatgttgcaaaattacgggatggctaccagcactcgtgcttggctaacccatacgtggtcatcttgcgcgatcattgtgactgccggaagactcttgtctagccaccgcaggaaatattcacattgtggaaaggatctgtgcccctcagggttccaaacgttccactccgcggcaggggcgggggcgagtccggagggcgggtccaaggcgcccaggtggccgcggcagaagggcctgtttctctggccttggctgtggttggcagccggccggggagagaagggactcagggaggcaacctggttcccgcccgttgctgatttcgcagcggctctcccgggccgcccccttttccttcctcctcaggccgcgacttggagggttccgctccgcggcgggggcagagccaggggcggggctgagcgcggcctgggcgatctccccggcggctggggtgggctggcgtcttcttcgcgcccgggggacctcctcgcgaccgccgggacgtaaaaggggcttggcaggggcgtcctcgccccactcccggaacctggtttcccgctgctcccgcgagcgtcgggagcccagcaggcctggccgaggcgggaccttcgtcgctccagcccccgtccccgcccccgcgcctccccgccgcgcggagctctggttggcttgctttccaaccggactttggggctagcgtttagaaaagtctcgacctcctccggcccggtcccatcccaagaaccgactaaggctgtgagtgtccgggaaccagacccgcttggaggccacagccccgacgtcccgcgcccacgcggcagatcgggcgctgcggcctgggagcctcggggagatgcggagcaggagcaattccggggtccgcttggacgggtacgcgcggctggtgcagcaaaccatcctgtgttaccagaatcccgtcacggggctgctgtcagccagccatgagcagaaggatgcctgggtgcgggataacatctacagtatcctggccgtgtggggcctgggcatggcctaccgtaagaatgcagaccgcgatgaggacaaggccaaggcctacgagctggagcagaacgtggtgaagctgatgcgaggtcttctccagtgcatgatgagacaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggcttacgtatcattttcactctcgatgaggtggccttcatacagaatcttgtcttttacatagaagctgcatataaagtcgctgattatggaatgtgggagcgtggagataagactaatcagggcatcccggaattgaatgcaagctccgtaggaatggccaaggcagctcttgaggcaattgatgaactggacctttttggagcccatggaggacgcaagtcagtgattcatgttctgccagatgaggtcgagcactgccagtctattctgttctccatgctgccaagagcgtcgacatctaaagaaattgatgctggacttctttccattatttccttcccggcctttgcagtggaagatgtaaaccttgtaaatgtgaccaaaaatgaaattatttctaagctccaggggcgttatggatgctgtcgcttccttcgagatggttataaaactccaagagaggaccctaatcgactgcattatgaccctgctgaactcaagctcttcgaaaacattgaatgtgagtggcctgtgttttggacatattttataatagatggagtcttcagtggtgatgctgttcaggtccaagaataccgagaggccctggagggaatactcatcagaggcaagaatgggatccgcctggtgcctgaactctacgctgtcccgcctaacaaggtagatgaagagtacaagaatcctcacacagtagaccgagttcctatggggaaggtgcctcatctgtggggccaatccttgtacatcctcagctcgctgttggcagagggattccttgccgctggtgaaatcgatcccttaaatagaagattttccacttcagtcaaacctgatgttgtagtacaagttactgttttggcagaaaacaatcacattaaggacttattgaggaaacacggggtgaacgtccagagtatcgcggacattcatccaattcaagtccagccgggccggattcttagtcacatatatgccaagcttggacggaataagaatatgaatttgagtgggcgaccgtatcgacatattggtgtccttggaacctctaaactatatgtgattaggaaccaaatctttacttttacaccccagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcacaaatgatggctcagacattcattctgctgtgctctccacaattagaaaactagaggatggatattttggaggagccagagtaaaattagggaacctttcggaatttctcaccacatcgttctacacatatctgacttttctggatccagactgtgatgagaagttgtttgacaatgccagcgaagggactttcagtcctgatagtgattcagatttggtaggatatctggaagacacctgtaatcaagaaagccaagacgaacttgaccattatatcaaccaccttctgcaaagcacatcgttgaggtcctatctgcctcctctttgtaagaacacagaagaccgccatgtcttcagtgctatccactccacgcgggacatactttctgtgatggcaaaagcaaagggtttggaagttccatttgttcccatgactttgccgactaaagttctaagtgcccaccgtaaatcactgaatcttgttgattctcctcagccactcctagaaaaggttcctgaaagtgactttcagtggcccagagatgaccatggtgacgtggactgtgagaagctggttgagcagctaaaagattgttcgaacctacaggaccaagcagacattctgtacattctttatgtcataaagggtcccagctgggacacaaatctctctggacagcacggggtcaccgttcaaaaccttcttggtgagctctatgggaaagccggcttgaaccaggagtggggtctgattcgctacatctcaggccttctcaggaagaaagtggaggtcctggctgaggcctgcacagacctgctttcgcaccagaagcagctcaccgtgggcctgccgcccgagccccgggagaagatcatctctgcgccccttcccccagaggagctcacaaaactcatctacgaggccagtgggcaggacatcagcattgccgtcctcacgcaggagattgtggtttacctggccatgtatgtcagggcgcagcccagcctctttgtggagatgctgagactccggattggactgatcattcaggtgatggccacggagctggcacggagcctgaactgctcaggagaagaggcttctgaaagtttgatgaacctcagccctttcgatatgaaaaatctcctgcaccatattctaagtgggaaagagtttggcgttgaaagaagtgtgcgccctatccactcctccacatccagccctaccatctccatccacgaggtgggccataccggagtcaccaaaactgagaggagtggcattaacagactgaggagtgaaatgaaacagatgactaggcggtttagtgctgatgaacagttcttttctgtgggccaggccgcgtccagcagtgcgcattcctccaagtctgcgaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgctcacctagtggccaggaggtgcgctctgtctggttgagagc

SEQ ID NO: 420051 - DNA, 5168 bp, Homo sapiens
tcctcccttggtagccactcttgtgacaggaaggccttcttcccagccggtgaagggtcacagtgtcgttaatgttcaaagtgtagcactcatgttgcaaaattacgggatggctaccagcactcgtgcttggctaacccatacgtggtcatcttgcgcgatcattgtgactgccggaagactcttgtctagccaccgcaggaaatattcacattgtggaaaggatctgtgcccctcagggttccaaacgttccactccgcggcaggggcgggggcgagtccggagggcgggtccaaggcgcccaggtggccgcggcagaagggcctgtttctctggccttggctgtggttggcagccggccggggagagaagggactcagggaggcaacctggttcccgcccgttgctgatttcgcagcggctctcccgggccgcccccttttccttcctcctcaggccgcgacttggagggttccgctccgcggcgggggcagagccaggggcggggctgagcgcggcctgggcgatctccccggcggctggggtgggctggcgtcttcttcgcgcccgggggacctcctcgcgaccgccgggacgtaaaaggggcttggcaggggcgtcctcgccccactcccggaacctggtttcccgctgctcccgcgagcgtcgggagcccagcaggcctggccgaggcgggaccttcgtcgctccagcccccgtccccgcccccgcgcctccccgccgcgcggagctctggttggcttgctttccaaccggactttggggctagcgtttagaaaagtctcgacctcctccggcccggtcccatcccaagaaccgactaaggctgtgagtgtccgggaaccagacccgcttggaggccacagccccgacgtcccgcgcccacgcggcagatcgggcgctgcggcctgggagcctcggggagatgcggagcaggagcaattccggggtccgcttggacgggtacgcgcggctggtgcagcaaaccatcctgtgttaccagaatcccgtcacggggctgctgtcagccagccatgagcagaaggatgcctgggtgcgggataacatctacagtatcctggccgtgtggggcctgggcatggcctaccgtaagaatgcagaccgcgatgaggacaaggccaaggcctacgagctggagcagaacgtggtgaagctgatgcgaggtcttctccagtgcatgatgagacaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggcttacgtatcattttcactctcgatgaggtggccttcatacagaatcttgtcttttacatagaagctgcatataaagtcgctgattatggaatgtgggagcgtggagataagactaatcagggcatcccggaattgaatgcaagctccgtaggaatggccaaggcagctcttgaggcaattgatgaactggacctttttggagcccatggaggacgcaagtcagtgattcatgttctgccagatgaggtcgagcactgccagtctattctgttctccatgctgccaagagcgtcgacatctaaagaaattgatgctggacttctttccattatttccttcccggcctttgcagtggaagatgtaaaccttgtaaatgtgaccaaaaatgaaattatttctaagctccaggggcgttatggatgctgtcgcttccttcgagatggttataaaactccaagagaggaccctaatcgactgcattatgaccctgctgaactcaagctcttcgaaaacattgaatgtgagtggcctgtgttttggacatattttataatagatggagtcttcagtggtgatgctgttcaggtccaagaataccgagaggccctggagggaatactcatcagaggcaagaatgggatccgcctggtgcctgaactctacgctgtcccgcctaacaaggtagatgaagagtacaagaatcctcacacagtagaccgagttcctatggggaaggtgcctcatctgtggggccaatccttgtacatcctcagctcgctgttggcagagggattccttgccgctggtgaaatcgatcccttaaatagaagattttccacttcagtcaaacctgatgttgtagtacaagttactgttttggcagaaaacaatcacattaaggacttattgaggaaacacggggtgaacgtccagagtatcgcggacattcatccaattcaagtccagccgggccggattcttagtcacatatatgccaagcttggacggaataagaatatgaatttgagtgggcgaccgtatcgacatattggtgtccttggaacctctaaactatatgtgattaggaaccaaatctttacttttacaccccagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcacaaatgatggctcagacattcattctgctgtgctctccacaattagaaaactagaggatggatattttggaggagccagagtaaaattagggaacctttcggaatttctcaccacatcgttctacacatatctgacttttctggatccagactgtgatgagaagttgtttgacaatgccagcgaagggactttcagtcctgatagtgattcagatttggtaggatatctggaagacacctgtaatcaagaaagccaagacgaacttgaccattatatcaaccaccttctgcaaagcacatcgttgaggtcctatctgcctcctctttgtaagaacacagaagaccgccatgtcttcagtgctatccactccacgcgggacatactttctgtgatggcaaaagcaaagggtttggaagttccatttgttcccatgactttgccgactaaagttctaagtgcccaccgtaaatcactgaatcttgttgattctcctcagccactcctagaaaaggttcctgaaagtgactttcagtggcccagagatgaccatggtgacgtggactgtgagaagctggttgagcagctaaaagattgttcgaacctacaggaccaagcagacattctgtacattctttatgtcataaagggtcccagctgggacacaaatctctctggacagcacggggtcaccgttcaaaaccttcttggtgagctctatgggaaagccggcttgaaccaggagtggggtctgattcgctacatctcaggccttctcaggaagaaagtggaggtcctggctgaggcctgcacagacctgctttcgcaccagaagcagctcaccgtgggcctgccgcccgagccccgggagaagatcatctctgcgccccttcccccagaggagctcacaaaactcatctacgaggccagtgggcaggacatcagcattgccgtcctcacgcaggagattgtggtttacctggccatgtatgtcagggcgcagcccagcctctttgtggagatgctgagactccggattggactgatcattcaggtgatggccacggagctggcacggagcctgaactgctcaggagaagaggcttctgaaagtttgatgaacctcagccctttcgatatgaaaaatctcctgcaccatattctaagtgggaaagagtttggcgttgaaagaagtgtgcgccctatccactcctccacatccagccctaccatctccatccacgaggtgggccataccggagtcaccaaaactgagaggagtggcattaacagactgaggagtgaaatgaaacagatgactaggcggtttagtgctgatgaacagttcttttctgtgggccaggccgcgtccagcagtgcgcattcctccaagtctgcgaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtgg

SEQ ID NO: 420052 - DNA, 6000 bp, Homo sapiens
tcctcccttggtagccactcttgtgacaggaaggccttcttcccagccggtgaagggtcacagtgtcgttaatgttcaaagtgtagcactcatgttgcaaaattacgggatggctaccagcactcgtgcttggctaacccatacgtggtcatcttgcgcgatcattgtgactgccggaagactcttgtctagccaccgcaggaaatattcacattgtggaaaggatctgtgcccctcagggttccaaacgttccactccgcggcaggggcgggggcgagtccggagggcgggtccaaggcgcccaggtggccgcggcagaagggcctgtttctctggccttggctgtggttggcagccggccggggagagaagggactcagggaggcaacctggttcccgcccgttgctgatttcgcagcggctctcccgggccgcccccttttccttcctcctcaggccgcgacttggagggttccgctccgcggcgggggcagagccaggggcggggctgagcgcggcctgggcgatctccccggcggctggggtgggctggcgtcttcttcgcgcccgggggacctcctcgcgaccgccgggacgtaaaaggggcttggcaggggcgtcctcgccccactcccggaacctggtttcccgctgctcccgcgagcgtcgggagcccagcaggcctggccgaggcgggaccttcgtcgctccagcccccgtccccgcccccgcgcctccccgccgcgcggagctctggttggcttgctttccaaccggactttggggctagcgtttagaaaagtctcgacctcctccggcccggtcccatcccaagaaccgactaaggctgtgagtgtccgggaaccagacccgcttggaggccacagccccgacgtcccgcgcccacgcggcagatcgggcgctgcggcctgggagcctcggggagatgcggagcaggagcaattccggggtccgcttggacgggtacgcgcggctggtgcagcaaaccatcctgtgttaccagaatcccgtcacggggctgctgtcagccagccatgagcagaaggatgcctgggtgcgggataacatctacagtatcctggccgtgtggggcctgggcatggcctaccgtaagaatgcagaccgcgatgaggacaaggccaaggcctacgagctggagcagaacgtggtgaagctgatgcgaggtcttctccagtgcatgatgagacaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggcttacgtatcattttcactctcgatgaggtggccttcatacagaatcttgtcttttacatagaagctgcatataaagtcgctgattatggaatgtgggagcgtggagataagactaatcagggcatcccggaattgaatgcaagctccgtaggaatggccaaggcagctcttgaggcaattgatgaactggacctttttggagcccatggaggacgcaagtcagtgattcatgttctgccagatgaggtcgagcactgccagtctattctgttctccatgctgccaagagcgtcgacatctaaagaaattgatgctggacttctttccattatttccttcccggcctttgcagtggaagatgtaaaccttgtaaatgtgaccaaaaatgaaattatttctaagctccaggggcgttatggatgctgtcgcttccttcgagatggttataaaactccaagagaggaccctaatcgactgcattatgaccctgctgaactcaagctcttcgaaaacattgaatgtgagtggcctgtgttttggacatattttataatagatggagtcttcagtggtgatgctgttcaggtccaagaataccgagaggccctggagggaatactcatcagaggcaagaatgggatccgcctggtgcctgaactctacgctgtcccgcctaacaaggtagatgaagagtacaagaatcctcacacagtagaccgagttcctatggggaaggtgcctcatctgtggggccaatccttgtacatcctcagctcgctgttggcagagggattccttgccgctggtgaaatcgatcccttaaatagaagattttccacttcagtcaaacctgatgttgtagtacaagttactgttttggcagaaaacaatcacattaaggacttattgaggaaacacggggtgaacgtccagagtatcgcggacattcatccaattcaagtccagccgggccggattcttagtcacatatatgccaagcttggacggaataagaatatgaatttgagtgggcgaccgtatcgacatattggtgtccttggaacctctaaactatatgtgattaggaaccaaatctttacttttacaccccagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcacaaatgatggctcagacattcattctgctgtgctctccacaattagaaaactagaggatggatattttggaggagccagagtaaaattagggaacctttcggaatttctcaccacatcgttctacacatatctgacttttctggatccagactgtgatgagaagttgtttgacaatgccagcgaagggactttcagtcctgatagtgattcagatttggtaggatatctggaagacacctgtaatcaagaaagccaagacgaacttgaccattatatcaaccaccttctgcaaagcacatcgttgaggtcctatctgcctcctctttgtaagaacacagaagaccgccatgtcttcagtgctatccactccacgcgggacatactttctgtgatggcaaaagcaaagggtttggaagttccatttgttcccatgactttgccgactaaagttctaagtgcccaccgtaaatcactgaatcttgttgattctcctcagccactcctagaaaaggttcctgaaagtgactttcagtggcccagagatgaccatggtgacgtggactgtgagaagctggttgagcagctaaaagattgttcgaacctacaggaccaagcagacattctgtacattctttatgtcataaagggtcccagctgggacacaaatctctctggacagcacggggtcaccgttcaaaaccttcttggtgagctctatgggaaagccggcttgaaccaggagtggggtctgattcgctacatctcaggccttctcaggaagaaagtggaggtcctggctgaggcctgcacagacctgctttcgcaccagaagcagctcaccgtgggcctgccgcccgagccccgggagaagatcatctctgcgccccttcccccagaggagctcacaaaactcatctacgaggccagtgggcaggacatcagcattgccgtcctcacgcaggagattgtggtttacctggccatgtatgtcagggcgcagcccagcctctttgtggagatgctgagactccggattggactgatcattcaggtgatggccacggagctggcacggagcctgaactgctcaggagaagaggcttctgaaagtttgatgaacctcagccctttcgatatgaaaaatctcctgcaccatattctaagtgggaaagagtttggcgttgaaagaagtgatacgaggtctcaccatgctgcccaggctggtcttgaactcctgggctcaagcagtcttcccacctcggcctcccaaagtgctgggattacaggtgtgagccaccgtgcctggcctcggtgcgccctatccactcctccacatccagccctaccatctccatccacgaggtgggccataccggagtcaccaaaactgagaggagtggcattaacagactgaggagtgaaatgaaacagatgactaggcggtttagtgctgatgaacagttcttttctgtgggccaggccgcgtccagcagtgcgcattcctccaagtctgcgaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgctcacctagtggccaggaggtgcgctctgtctggttgagagc

SEQ ID NO: 420053 - DNA, 5829 bp, Homo sapiens
tcctcccttggtagccactcttgtgacaggaaggccttcttcccagccggtgaagggtcacagtgtcgttaatgttcaaagtgtagcactcatgttgcaaaattacgggatggctaccagcactcgtgcttggctaacccatacgtggtcatcttgcgcgatcattgtgactgccggaagactcttgtctagccaccgcaggaaatattcacattgtggaaaggatctgtgcccctcagggttccaaacgttccactccgcggcaggggcgggggcgagtccggagggcgggtccaaggcgcccaggtggccgcggcagaagggcctgtttctctggccttggctgtggttggcagccggccggggagagaagggactcagggaggcaacctggttcccgcccgttgctgatttcgcagcggctctcccgggccgcccccttttccttcctcctcaggccgcgacttggagggttccgctccgcggcgggggcagagccaggggcggggctgagcgcggcctgggcgatctccccggcggctggggtgggctggcgtcttcttcgcgcccgggggacctcctcgcgaccgccgggacgtaaaaggggcttggcaggggcgtcctcgccccactcccggaacctggtttcccgctgctcccgcgagcgtcgggagcccagcaggcctggccgaggcgggaccttcgtcgctccagcccccgtccccgcccccgcgcctccccgccgcgcggagctctggttggcttgctttccaaccggactttggggctagcgtttagaaaagtctcgacctcctccggcccggtcccatcccaagaaccgactaaggctgtgagtgtccgggaaccagacccgcttggaggccacagccccgacgtcccgcgcccacgcggcagatcgggcgctgcggcctgggagcctcggggagatgcggagcaggagcaattccggggtccgcttggacgggtacgcgcggctggtgcagcaaaccatcctgtgttaccagaatcccgtcacggggctgctgtcagccagccatgagcagaaggatgcctgggtgcgggataacatctacagtatcctggccgtgtggggcctgggcatggcctaccgtaagaatgcagaccgcgatgaggacaaggccaaggcctacgagctggagcagaacgtggtgaagctgatgcgaggtcttctccagtgcatgatgagacaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggcttacgtatcattttcactctcgatgaggtggccttcatacagaatcttgtcttttacatagaagctgcatataaagtcgctgattatggaatgtgggagcgtggagataagactaatcagggcatcccggaattgaatgcaagctccgtaggaatggccaaggcagctcttgaggcaattgatgaactggacctttttggagcccatggaggacgcaagtcagtgattcatgttctgccagatgaggtcgagcactgccagtctattctgttctccatgctgccaagagcgtcgacatctaaagaaattgatgctggacttctttccattatttccttcccggcctttgcagtggaagatgtaaaccttgtaaatgtgaccaaaaatgaaattatttctaagctccaggggcgttatggatgctgtcgcttccttcgagatggttataaaactccaagagaggaccctaatcgactgcattatgaccctgctgaactcaagctcttcgaaaacattgaatgtgagtggcctgtgttttggacatattttataatagatggagtcttcagtggtgatgctgttcaggtccaagaataccgagaggccctggagggaatactcatcagaggcaagaatgggatccgcctggtgcctgaactctacgctgtcccgcctaacaaggtagatgaagagtacaagaatcctcacacagtagaccgagttcctatggggaaggtgcctcatctgtggggccaatccttgtacatcctcagctcgctgttggcagagggattccttgccgctggtgaaatcgatcccttaaatagaagattttccacttcagtcaaacctgatgttgtagtacaagttactgttttggcagaaaacaatcacattaaggacttattgaggaaacacggggtgaacgtccagagtatcgcggacattcatccaattcaagtccagccgggccggattcttagtcacatatatgccaagcttggacggaataagaatatgaatttgagtgggcgaccgtatcgacatattggtgtccttggaacctctaaactatatgtgattaggaaccaaatctttacttttacaccccagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcacaaatgatggctcagacattcattctgctgtgctctccacaattagaaaactagaggatggatattttggaggagccagagtaaaattagggaacctttcggaatttctcaccacatcgttctacacatatctgacttttctggatccagactgtgatgagaagttgtttgacaatgccagcgaagggactttcagtcctgatagtgattcagatttggtaggatatctggaagacacctgtaatcaagaaagccaagacgaacttgaccattatatcaaccaccttctgcaaagcacatcgttgaggtcctatctgcctcctctttgtaagaacacagaagaccgccatgtcttcagtgctatccactccacgcgggacatactttctgtgatggcaaaagcaaagggtttggaagttccatttgttcccatgactttgccgactaaagttctaagtgcccaccgtaaatcactgaatcttgttgattctcctcagccactcctagaaaaggttcctgaaagtgactttcagtggcccagagatgaccatggtgacgtggactgtgagaagctggttgagcagctaaaagattgttcgaacctacaggaccaagcagacattctgtacattctttatgtcataaagggtcccagctgggacacaaatctctctggacagcacggggtcaccgttcaaaaccttcttggtgagctctatgggaaagccggcttgaaccaggagtggggtctgattcgctacatctcaggccttctcaggaagaaagtggaggtcctggctgaggcctgcacagacctgctttcgcaccagaagcagctcaccgtgggcctgccgcccgagccccgggagaagatcatctctgcgtaagtcctcagccttggggacctcaggagattgtggtttacctggccatgtatgtcagggcgcagcccagcctctttgtggagatgctgagactccggattggactgatcattcaggtgatggccacggagctggcacggagcctgaactgctcaggagaagaggcttctgaaagtttgatgaacctcagccctttcgatatgaaaaatctcctgcaccatattctaagtgggaaagagtttggcgttgaaagaagtgtgcgccctatccactcctccacatccagccctaccatctccatccacgaggtgggccataccggagtcaccaaaactgagaggagtggcattaacagactgaggagtgaaatgaaacagatgactaggcggtttagtgctgatgaacagttcttttctgtgggccaggccgcgtccagcagtgcgcattcctccaagtctgcgaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgctcacctagtggccaggaggtgcgctctgtctggttgagagc

SEQ ID NO: 420054 - DNA, 3916 bp, Homo sapiens
aatgcatggttagaggcctgggtgtccaagaataccgagaggccctggagggaatactcatcagaggcaagaatgggatccgcctggtgcctgaactctacgctgtcccgcctaacaaggtagatgaagagtacaagaatcctcacacagtagaccgagttcctatggggaaggtgcctcatctgtggggccaatccttgtacatcctcagctcgctgttggcagagggattccttgccgctggtgaaatcgatcccttaaatagaagattttccacttcagtcaaacctgatgttgtagtacaagttactgttttggcagaaaacaatcacattaaggacttattgaggaaacacggggtgaacgtccagagtatcgcggacattcatccaattcaagtccagccgggccggattcttagtcacatatatgccaagcttggacggaataagaatatgaatttgagtgggcgaccgtatcgacatattggtgtccttggaacctctaaactatatgtgattaggaaccaaatctttacttttacaccccagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcacaaatgatggctcagacattcattctgctgtgctctccacaattagaaaactagaggatggatattttggaggagccagagtaaaattagggaacctttcggaatttctcaccacatcgttctacacatatctgacttttctggatccagactgtgatgagaagttgtttgacaatgccagcgaagggactttcagtcctgatagtgattcagatttggtaggatatctggaagacacctgtaatcaagaaagccaagacgaacttgaccattatatcaaccaccttctgcaaagcacatcgttgaggtcctatctgcctcctctttgtaagaacacagaagaccgccatgtcttcagtgctatccactccacgcgggacatactttctgtgatggcaaaagcaaagggtttggaagttccatttgttcccatgactttgccgactaaagttctaagtgcccaccgtaaatcactgaatcttgttgattctcctcagccactcctagaaaaggttcctgaaagtgactttcagtggcccagagatgaccatggtgacgtggactgtgagaagctggttgagcagctaaaagattgttcgaacctacaggaccaagcagacattctgtacattctttatgtcataaagggtcccagctgggacacaaatctctctggacagcacggggtcaccgttcaaaaccttcttggtgagctctatgggaaagccggcttgaaccaggagtggggtctgattcgctacatctcaggccttctcaggaagaaagtggaggtcctggctgaggcctgcacagacctgctttcgcaccagaagcagctcaccgtgggcctgccgcccgagccccgggagaagatcatctctgcgccccttcccccagaggagctcacaaaactcatctacgaggccagtgggcaggacatcagcattgccgtcctcacgcaggagattgtggtttacctggccatgtatgtcagggcgcagcccagcctctttgtggagatgctgagactccggattggactgatcattcaggtgatggccacggagctggcacggagcctgaactgctcaggagaagaggcttctgaaagtttgatgaacctcagccctttcgatatgaaaaatctcctgcaccatattctaagtgggaaagagtttggcgttgaaagaagtgtgcgccctatccactcctccacatccagccctaccatctccatccacgaggtgggccataccggagtcaccaaaactgagaggagtggcattaacagactgaggagtgaaatgaaacagatgactaggcggtttagtgctgatgaacagttcttttctgtgggccaggccgcgtccagcagtgcgcattcctccaagtctgcgaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgctcacctagtggccaggaggtgcgctctgtctggttgagagc

SEQ ID NO: 420055 - DNA, 5890 bp, Homo sapiens
tcctcccttggtagccactcttgtgacaggaaggccttcttcccagccggtgaagggtcacagtgtcgttaatgttcaaagtgtagcactcatgttgcaaaattacgggatggctaccagcactcgtgcttggctaacccatacgtggtcatcttgcgcgatcattgtgactgccggaagactcttgtctagccaccgcaggaaatattcacattgtggaaaggatctgtgcccctcagggttccaaacgttccactccgcggcaggggcgggggcgagtccggagggcgggtccaaggcgcccaggtggccgcggcagaagggcctgtttctctggccttggctgtggttggcagccggccggggagagaagggactcagggaggcaacctggttcccgcccgttgctgatttcgcagcggctctcccgggccgcccccttttccttcctcctcaggccgcgacttggagggttccgctccgcggcgggggcagagccaggggcggggctgagcgcggcctgggcgatctccccggcggctggggtgggctggcgtcttcttcgcgcccgggggacctcctcgcgaccgccgggacgtaaaaggggcttggcaggggcgtcctcgccccactcccggaacctggtttcccgctgctcccgcgagcgtcgggagcccagcaggcctggccgaggcgggaccttcgtcgctccagcccccgtccccgcccccgcgcctccccgccgcgcggagctctggttggcttgctttccaaccggactttggggctagcgtttagaaaagtctcgacctcctccggcccggtcccatcccaagaaccgactaaggctgtgagtgtccgggaaccagacccgcttggaggccacagccccgacgtcccgcgcccacgcggcagatcgggcgctgcggcctgggagcctcggggagatgcggagcaggagcaattccggggtccgcttggacgggtacgcgcggctggtgcagcaaaccatcctgtgttaccagaatcccgtcacggggctgctgtcagccagccatgagcagaaggatgcctgggtgcgggataacatctacagtatcctggccgtgtggggcctgggcatggcctaccgtaagaatgcagaccgcgatgaggacaaggccaaggcctacgagctggagcagaacgtggtgaagctgatgcgaggtcttctccagtgcatgatgagacaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggcttacgtatcattttcactctcgatgaggtggccttcatacagaatcttgtcttttacatagaagctgcatataaagtcgctgattatggaatgtgggagcgtggagataagactaatcagggcatcccggaattgaatgcaagctccgtaggaatggccaaggcagctcttgaggcaattgatgaactggacctttttggagcccatggaggacgcaagtcagtgattcatgttctgccagatgaggtcgagcactgccagtctattctgttctccatgctgccaagagcgtcgacatctaaagaaattgatgctggacttctttccattatttccttcccggcctttgcagtggaagatgtaaaccttgtaaatgtgaccaaaaatgaaattatttctaagctccaggggcgttatggatgctgtcgcttccttcgagatggttataaaactccaagagaggaccctaatcgactgcattatgaccctgctgaactcaagctcttcgaaaacattgaatgtgagtggcctgtgttttggacatattttataatagatggagtcttcagtggtgatgctgttcaggtccaagaataccgagaggccctggagggaatactcatcagaggcaagaatgggatccgcctggtgcctgaactctacgctgtcccgcctaacaaggtagatgaagagtacaagaatcctcacacagtagaccgagttcctatggggaaggtgcctcatctgtggggccaatccttgtacatcctcagctcgctgttggcagagggattccttgccgctggtgaaatcgatcccttaaatagaagattttccacttcagtcaaacctgatgttgtagtacaagttactgttttggcagaaaacaatcacattaaggacttattgaggaaacacggggtgaacgtccagagtatcgcggacattcatccaattcaagtccagccgggccggattcttagtcacatatatgccaagcttggacggaataagaatatgaatttgagtgggcgaccgtatcgacatattggtgtccttggaacctctaaactatatgtgattaggaaccaaatctttacttttacaccccagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcacaaatgatggctcagacattcattctgctgtgctctccacaattagaaaactagaggatggatattttggaggagccagagtaaaattagggaacctttcggaatttctcaccacatcgttctacacatatctgacttttctggatccagactgtgatgagaagttgtttgacaatgccagcgaagggactttcagtcctgatagtgattcagatttggtaggatatctggaagacacctgtaatcaagaaagccaagacgaacttgaccattatatcaaccaccttctgcaaagcacatcgttgaggtcctatctgcctcctctttgtaagaacacagaagaccgccatgtcttcagtgctatccactccacgcgggacatactttctgtgatggcaaaagcaaagggtttggaagttccatttgttcccatgactttgccgactaaagttctaagtgcccaccgtaaatcactgaatcttgttgattctcctcagccactcctagaaaaggttcctgaaagtgactttcagtggcccagagatgaccatggtgacgtggactgtgagaagctggttgagcagctaaaagattgttcgaacctacaggaccaagcagacattctgtacattctttatgtcataaagggtcccagctgggacacaaatctctctggacagcacggggtcaccgttcaaaaccttcttggtgagctctatgggaaagccggcttgaaccaggagtggggtctgattcgctacatctcaggccttctcaggaagaaagtggaggtcctggctgaggcctgcacagacctgctttcgcaccagaagcagctcaccgtgggcctgccgcccgagccccgggagaagatcatctctgcgccccttcccccagaggagctcacaaaactcatctacgaggccagtgggcaggacatcagcattgccgtcctcacgcaggagattgtggtttacctggccatgtatgtcagggcgcagcccagcctctttgtggagatgctgagactccggattggactgatcattcaggtgatggccacggagctggcacggagcctgaactgctcaggagaagaggcttctgaaagtttgatgaacctcagccctttcgatatgaaaaatctcctgcaccatattctaagtgggaaagagtttggcgttgaaagaagtgatacgaggtctcaccatgctgcccaggctggtcttgaactcctgggctcaagcagtcttcccacctcggcctcccaaagtgctgggattacagtgcgccctatccactcctccacatccagccctaccatctccatccacgaggtgggccataccggagtcaccaaaactgagaggagtggcattaacagactgaggagtgaaatgaaacagaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgctcacctagtggccaggaggtgcgctctgtctggttgagagc

SEQ ID NO: 420056 - DNA, 5797 bp, Homo sapiens
tcctcccttggtagccactcttgtgacaggaaggccttcttcccagccggtgaagggtcacagtgtcgttaatgttcaaagtgtagcactcatgttgcaaaattacgggatggctaccagcactcgtgcttggctaacccatacgtggtcatcttgcgcgatcattgtgactgccggaagactcttgtctagccaccgcaggaaatattcacattgtggaaaggatctgtgcccctcagggttccaaacgttccactccgcggcaggggcgggggcgagtccggagggcgggtccaaggcgcccaggtggccgcggcagaagggcctgtttctctggccttggctgtggttggcagccggccggggagagaagggactcagggaggcaacctggttcccgcccgttgctgatttcgcagcggctctcccgggccgcccccttttccttcctcctcaggccgcgacttggagggttccgctccgcggcgggggcagagccaggggcggggctgagcgcggcctgggcgatctccccggcggctggggtgggctggcgtcttcttcgcgcccgggggacctcctcgcgaccgccgggacgtaaaaggggcttggcaggggcgtcctcgccccactcccggaacctggtttcccgctgctcccgcgagcgtcgggagcccagcaggcctggccgaggcgggaccttcgtcgctccagcccccgtccccgcccccgcgcctccccgccgcgcggagctctggttggcttgctttccaaccggactttggggctagcgtttagaaaagtctcgacctcctccggcccggtcccatcccaagaaccgactaaggctgtgagtgtccgggaaccagacccgcttggaggccacagccccgacgtcccgcgcccacgcggcagatcgggcgctgcggcctgggagcctcggggagatgcggagcaggagcaattccggggtccgcttggacgggtacgcgcggctggtgcagcaaaccatcctgtgttaccagaatcccgtcacggggctgctgtcagccagccatgagcagaaggatgcctgggtgcgggataacatctacagtatcctggccgtgtggggcctgggcatggcctaccgtaagaatgcagaccgcgatgaggacaaggccaaggcctacgagctggagcagaacgtggtgaagctgatgcgaggtcttctccagtgcatgatgagacaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggcttacgtatcattttcactctcgatgaggtggccttcatacagaatcttgtcttttacatagaagctgcatataaagtcgctgattatggaatgtgggagcgtggagataagactaatcagggcatcccggaattgaatgcaagctccgtaggaatggccaaggcagctcttgaggcaattgatgaactggacctttttggagcccatggaggacgcaagtcagtgattcatgttctgccagatgaggtcgagcactgccagtctattctgttctccatgctgccaagagcgtcgacatctaaagaaattgatgctggacttctttccattatttccttcccggcctttgcagtggaagatgtaaaccttgtaaatgtgaccaaaaatgaaattatttctaagctccaggggcgttatggatgctgtcgcttccttcgagatggttataaaactccaagagaggaccctaatcgactgcattatgaccctgctgaactcaagctcttcgaaaacattgaatgtgagtggcctgtgttttggacatattttataatagatggagtcttcagtggtgatgctgttcaggtccaagaataccgagaggccctggagggaatactcatcagaggcaagaatgggatccgcctggtgcctgaactctacgctgtcccgcctaacaaggtagatgaagagtacaagaatcctcacacagtagaccgagttcctatggggaaggtgcctcatctgtggggccaatccttgtacatcctcagctcgctgttggcagagggattccttgccgctggtgaaatcgatcccttaaatagaagattttccacttcagtcaaacctgatgttgtagtacaagttactgttttggcagaaaacaatcacattaaggacttattgaggaaacacggggtgaacgtccagagtatcgcggacattcatccaattcaagtccagccgggccggattcttagtcacatatatgccaagcttggacggaataagaatatgaatttgagtgggcgaccgtatcgacatattggtgtccttggaacctctaaactatatgtgattaggaaccaaatctttacttttacaccccagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcacaaatgatggctcagacattcattctgctgtgctctccacaattagaaaactagaggatggatattttggaggagccagagtaaaattagggaacctttcggaatttctcaccacatcgttctacacatatctgacttttctggatccagactgtgatgagaagttgtttgacaatgccagcgaagggactttcagtcctgatagtgattcagatttggtaggatatctggaagacacctgtaatcaagaaagccaagacgaacttgaccattatatcaaccaccttctgcaaagcacatcgttgaggtcctatctgcctcctctttgtaagaacacagaagaccgccatgtcttcagtgctatccactccacgcgggacatactttctgtgatggcaaaagcaaagggtttggaagttccatttgttcccatgactttgccgactaaagttctaagtgcccaccgtaaatcactgaatcttgttgattctcctcagccactcctagaaaaggttcctgaaagtgactttcagtggcccagagatgaccatggtgacgtggactgtgagaagctggttgagcagctaaaagattgttcgaacctacaggaccaagcagacattctgtacattctttatgtcataaagggtcccagctgggacacaaatctctctggacagcacggggtcaccgttcaaaaccttcttggtgagctctatgggaaagccggcttgaaccaggagtggggtctgattcgctacatctcaggccttctcaggaagaaagtggaggtcctggctgaggcctgcacagacctgctttcgcaccagaagcagctcaccgtgggcctgccgcccgagccccgggagaagatcatctctgcgccccttcccccagaggagctcacaaaactcatctacgaggccagtgggcaggacatcagcattgccgtcctcacgcaggagattgtggtttacctggccatgtatgtcagggcgcagcccagcctctttgtggagatgctgagactccggattggactgatcattcaggtgatggccacggagctggcacggagcctgaactgctcaggagaagaggcttctgaaagtttgatgaacctcagccctttcgatatgaaaaatctcctgcaccatattctaagtgggaaagagtttggcgttgaaagaagtgtgcgccctatccactcctccacatccagccctaccatctccatccacgaggtgggccataccggagtcaccaaaactgagaggagtggcattaacagactgaggagtgaaatgaaacagaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgctcacctagtggccaggaggtgcgctctgtctggttgagagc

SEQ ID NO: 420057 - DNA, 2636 bp, Homo sapiens
aatagggaaagccggaaatgggattgcaaagggtgggtggatggaccctgatctgcgaggtcctcgccactaaacgcgggcttcactgtttgtcttcccccgtgtcatgtattgccttctctgtggttcctgtcctgtggaaacgtgtctgtcacttctctgtggcactgcagcaatgaagtgggcactatggagtttgtctccctgagccatggatgcctgctccgagggcccgttgtcaccctcaaagctctcccactgcagtggcacaggcgccacgtgcgggtgacagctgcccctcatgggcacttagcgcacactaggtatgcctcaggggcttctgtgtctccacgtggtgaaggcttccgggcagctctttataggatgcctgactgtgtccccactgtgcagatgagactgaggcccagaatcagtgttcatggcagggccagacggcctcgggtgtgtccttggcaccgctggcattgagtggggattagcactccggcagtctgacccccaagcccgtgctcgccctgttcggcctcctccttatgggttctagctttgggggtgggactgcctctcggggggcagggcagagtgcaacatggaatgaagtgatcaacccaaagtatgcgagtcatctcacatgaggaaacagacaaggtggactggaggaaccgtgttcctctctggcgagtggtgttctggcatttgtgcctaggtcgcagggccgcccttcgagatggcgcactttccctggggcacctgctgcgtggcttctgaggccccaagctgtctgtcttgcagaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgctcacctagtggccaggaggtgcgctctgtctggttgagagc

SEQ ID NO: 420058 - DNA, 2187 bp, Homo sapiens
  misc_feature (16)..(16): n is a, c, g, or t
  misc_feature (35)..(35): n is a, c, g, or t
  misc_feature (38)..(38): n is a, c, g, or t
  misc_feature (44)..(44): n is a, c, g, or t
gtcttgtgcctgaggntcctcatagaggcacgganctngcacgnagctgaactgctcaggagaagaggcttctgaaagtttgatgaacctcagccctttcgatatgaaaaatctcctgcaccatattctaagtgggaaagagtttggcgttgaaagaagtgtgcgccctatccactcctccacatccagccctaccatctccatccacgaggtgggccataccggagtcaccaaaactgagaggagtggcattaacagactgaggagtgaaatgaaacagatgactaggcggtttagtgctgatgaacagttcttttctgtgggccaggccgcgtccagcagtgcgcattcctccaagtctgcgaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgctcacctagtggccaggaggtgcgctctgtctggttgagagc

SEQ ID NO: 420059 - DNA, 2306 bp, Homo sapiens
gcgacagagtgagactccgtctcggaaaaaaaaaaaacatatctcactgtgtcggggcttcctggccactgtgttataatggtgcttaagtactctgcacacttccgtttactcctttaagagctgagtgctgcacctgtgctgctctcggtgctggagacacagcgctggccaggcagagaaggccctcattgtcaagtgggggagacaggggcagatcctgcctcgggttggatgctgtagagttcctgagaaccacgtgtgtgtgtttcccacccagtgcgccctatccactcctccacatccagccctaccatctccatccacgaggtgggccataccggagtcaccaaaactgagaggagtggcattaacagactgaggagtgaaatgaaacagatgactaggcggtttagtgctgatgaacagttcttttctgtgggccaggccgcgtccagcagtgcgcattcctccaagtctgcgaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgctcacctagtggccaggaggtgcgctctgtctggttgagagc

SEQ ID NO: 420060 - DNA, 5580 bp, Homo sapiens
tcctcccttggtagccactcttgtgacaggaaggccttcttcccagccggtgaagggtcacagtgtcgttaatgttcaaagtgtagcactcatgttgcaaaattacgggatggctaccagcactcgtgcttggctaacccatacgtggtcatcttgcgcgatcattgtgactgccggaagactcttgtctagccaccgcaggaaatattcacattgtggaaaggatctgtgcccctcagggttccaaacgttccactccgcggcaggggcgggggcgagtccggagggcgggtccaaggcgcccaggtggccgcggcagaagggcctgtttctctggccttggctgtggttggcagccggccggggagagaagggactcagggaggcaacctggttcccgcccgttgctgatttcgcagcggctctcccgggccgcccccttttccttcctcctcaggccgcgacttggagggttccgctccgcggcgggggcagagccaggggcggggctgagcgcggcctgggcgatctccccggcggctggggtgggctggcgtcttcttcgcgcccgggggacctcctcgcgaccgccgggacgtaaaaggggcttggcaggggcgtcctcgccccactcccggaacctggtttcccgctgctcccgcgagcgtcgggagcccagcaggcctggccgaggcgggaccttcgtcgctccagcccccgtccccgcccccgcgcctccccgccgcgcggagctctggttggcttgctttccaaccggactttggggctagcgtttagaaaagtctcgacctcctccggcccggtcccatcccaagaaccgactaaggctgtgagtgtccgggaaccagacccgcttggaggccacagccccgacgtcccgcgcccacgcggcagatcgggcgctgcggcctgggagcctcggggagatgcggagcaggagcaattccggggtccgcttggacgggtacgcgcggctggtgcagcaaaccatcctgtgttaccagaatcccgtcacggggctgctgtcagccagccatgagcagaaggatgcctgggtgcgggataacatctacagtatcctggccgtgtggggcctgggcatggcctaccgtaagaatgcagaccgcgatgaggacaaggccaaggcctacgagctggagcagaacgtggtgaagctgatgcgaggtcttctccagtgcatgatgagacaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggcttacgtatcattttcactctcgatgaggtggccttcatacagaatcttgtcttttacatagaagctgcatataaagtcgctgattatggaatgtgggagcgtggagataagactaatcagggcatcccggaattgaatgcaagctccgtaggaatggccaaggcagctcttgaggcaattgatgaactggacctttttggagcccatggaggacgcaagtcagtgattcatgttctgccagatgaggtcgagcactgccagtctattctgttctccatgctgccaagagcgtcgacatctaaagaaattgatgctggacttctttccattatttccttcccggcctttgcagtggaagatgtaaaccttgtaaatgtgaccaaaaatgaaattatttctaagctccaggggcgttatggatgctgtcgcttccttcgagatggttataaaactccaagagaggaccctaatcgactgcattatgaccctgctgaactcaagctcttcgaaaacattgaatgtgagtggcctgtgttttggacatattttataatagatggagtcttcagtggtgatgctgttcaggtccaagaataccgagaggccctggagggaatactcatcagaggcaagaatgggatccgcctggtgcctgaactctacgctgtcccgcctaacaaggtagatgaagagtacaagaatcctcacacagtagaccgagttcctatggggaaggtgcctcatctgtggggccaatccttgtacatcctcagctcgctgttggcagagggattccttgccgctggtgaaatcgatcccttaaatagaagattttccacttcagtcaaacctgatgttgtagtacaagttactgttttggcagaaaacaatcacattaaggacttattgaggaaacacggggtgaacgtccagagtatcgcggacattcatccaattcaagtccagccgggccggattcttagtcacatatatgccaagcttggacggaataagaatatgaatttgagtgggcgaccgtatcgacatattggtgtccttggaacctctaaactatatgtgattaggaaccaaatctttacttttacaccccagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcacaaatgatggctcagacattcattctgctgtgctctccacaattagaaaactagaggatggatattttggaggagccagagtaaaattagggaacctttcggaatttctcaccacatcgttctacacatatctgacttttctggatccagactgtgatgagaagttgtttgacaatgccagcgaagggactttcagtcctgatagtgattcagatttggtaggatatctggaagacacctgtaatcaagaaagccaagacgaacttgaccattatatcaaccaccttctgcaaagcacatcgttgaggtcctatctgcctcctctttgtaagaacacagaagaccgccatgtcttcagtgctatccactccacgcgggacatactttctgtgatggcaaaagcaaagggtttggaagttccatttgttcccatgactttgccgactaaagttctaagtgcccaccgtaaatcactgaatcttgttgattctcctcagccactcctagaaaaggttcctgaaagtgactttcagtggcccagagatgaccatggtgacgtggactgtgagaagctggttgagcagctaaaagattgttcgaacctacaggaccaagcagacattctgtacattctttatgtcataaagggtcccagctgggacacaaatctctctggacagcacggggtcaccgttcaaaaccttcttggtgagctctatgggaaagccggcttgaaccaggagtggggtctgattcgctacatctcaggccttctcaggaagaaagtggaggtcctggctgaggcctgcacagacctgctttcgcaccagaagcagctcaccgtgggcctgccgcccgagccccgggagaagatcatctctgcgccccttcccccagaggagctcacaaaactcatctacgaggccagtgggcaggacatcagcattgccgtcctcacgcaggagattgtggtttacctggccatgtatgtcagggcgcagcccagcctctttgtggagatgctgagactccggattggactgatcattcaggtgatggccacggagctggcacggagcctgaactgctcaggagaagaggcttctgaaagtttgatgaacctcagccctttcgatatgaaaaatctcctgcaccatattctaagtgggaaagagtttggcgttgaaagaagtgtgcgccctatccactcctccacatccagccctaccatctccatccacgaggtgggccataccggagtcaccaaaactgagaggagtggcattaacagactgaggagtgaaatgaaacagatgactaggcggtttagtgctgatgaacagttcttttctgtgggccaggccgcgtccagcagtgcgcattcctccaagtctgcgaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgctcacctagtggccaggaggtgcgctctgtctggttgagagc

SEQ ID NO: 420061 - DNA, 2295 bp, Homo sapiens
gggttcacaataagggcttcattgcatggactctgacctcttgtgctccttttgggctcattctaattgacaggccatttgtagctctgagctgtctagccccttcaccctcatatttggcaaaaatgtctttccagcatttattggcatcagcctttttcttcacctgagactcagcatttctgggctagcaagctctttgcatttgccagacaccccttagaaccctggtgaaagaaaggagccaatctccatgccaccctggcctgccccatgggcagccttctcggcccttttctccaactaaaaacagtaatcgtccctaggtgatttgtcattctttttaacatggatttttttttagttttaccccacccaaagcaccatgcttcatgctggaaggaataatgaagaggaaagagaaaccagaaatggtccctgctccctggaagctgtagtcgatggggggaagggtagataaatcaggcgaggacaggctggctcctggaggcatactccagcctcctgctctgagggccactgccagcaggatccagggagtggccagaaaaggggcagcagtggcgctgagccccgagcccaggcactgctacggtcacccttggttactcggtgattgattgatagggctgcatctgtcctctcactggtggttgcctgcctgtccctttggtagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgctcacctagtggccaggaggtgcgctctgtctggttgagagc

SEQ ID NO: 420062 - DNA, 1651 bp, Homo sapiens
gactagaggatccatgcacgctcggtatgtctcccatctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgctcacctagtggccaggaggtgcgctctgtctggttgagagc

SEQ ID NO: 420063 - DNA, 1575 bp, Homo sapiens
cggcacgaggggagcctgaactgctcaggagaagaggcttctgaaagtttgatgaacctcagccctttcgatatgaaaaatctcgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgctcacctagtggccaggaggtgcgctctgtctggttgagagc

SEQ ID NO: 420064 - DNA, 1729 bp, Homo sapiens
ccccaccctctctcgctgtcctctcatatgatcctcttccgactcttcttcacacgctagctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggcctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgctcacctagtggccaggaggtgcgctctgtctggttgagagc

SEQ ID NO: 420065 - DNA, 5737 bp, Homo sapiens
tcctcccttggtagccactcttgtgacaggaaggccttcttcccagccggtgaagggtcacagtgtcgttaatgttcaaagtgtagcactcatgttgcaaaattacgggatggctaccagcactcgtgcttggctaacccatacgtggtcatcttgcgcgatcattgtgactgccggaagactcttgtctagccaccgcaggaaatattcacattgtggaaaggatctgtgcccctcagggttccaaacgttccactccgcggcaggggcgggggcgagtccggagggcgggtccaaggcgcccaggtggccgcggcagaagggcctgtttctctggccttggctgtggttggcagccggccggggagagaagggactcagggaggcaacctggttcccgcccgttgctgatttcgcagcggctctcccgggccgcccccttttccttcctcctcaggccgcgacttggagggttccgctccgcggcgggggcagagccaggggcggggctgagcgcggcctgggcgatctccccggcggctggggtgggctggcgtcttcttcgcgcccgggggacctcctcgcgaccgccgggacgtaaaaggggcttggcaggggcgtcctcgccccactcccggaacctggtttcccgctgctcccgcgagcgtcgggagcccagcaggcctggccgaggcgggaccttcgtcgctccagcccccgtccccgcccccgcgcctccccgccgcgcggagctctggttggcttgctttccaaccggactttggggctagcgtttagaaaagtctcgacctcctccggcccggtcccatcccaagaaccgactaaggctgtgagtgtccgggaaccagacccgcttggaggccacagccccgacgtcccgcgcccacgcggcagatcgggcgctgcggcctgggagcctcggggagatgcggagcaggagcaattccggggtccgcttggacgggtacgcgcggctggtgcagcaaaccatcctgtgttaccagaatcccgtcacggggctgctgtcagccagccatgagcagaaggatgcctgggtgcgggataacatctacagtatcctggccgtgtggggcctgggcatggcctaccgtaagaatgcagaccgcgatgaggacaaggccaaggcctacgagctggagcagaacgtggtgaagctgatgcgaggtcttctccagtgcatgatgagacaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggcttacgtatcattttcactctcgatgaggtggccttcatacagaatcttgtcttttacatagaagctgcatataaagtcgctgattatggaatgtgggagcgtggagataagactaatcagggcatcccggaattgaatgcaagctccgtaggaatggccaaggcagctcttgaggcaattgatgaactggacctttttggagcccatggaggacgcaagtcagtgattcatgttctgccagatgaggtcgagcactgccagtctattctgttctccatgctgccaagagcgtcgacatctaaagaaattgatgctggacttctttccattatttccttcccggcctttgcagtggaagatgtaaaccttgtaaatgtgaccaaaaatgaaattatttctaagctccaggggcgttatggatgctgtcgcttccttcgagatggttataaaactccaagagaggaccctaatcgactgcattatgaccctgctgaactcaagctcttcgaaaacattgaatgtgagtggcctgtgttttggacatattttataatagatggagtcttcagtggtgatgctgttcaggtccaagaataccgagaggccctggagggaatactcatcagaggcaagaatgggatccgcctggtgcctgaactctacgctgtcccgcctaacaaggtagatgaagagtacaagaatcctcacacagtagaccgagttcctatggggaaggtgcctcatctgtggggccaatccttgtacatcctcagctcgctgttggcagagggattccttgccgctggtgaaatcgatcccttaaatagaagattttccacttcagtcaaacctgatgttgtagtacaagttactgttttggcagaaaacaatcacattaaggacttattgaggaaacacggggtgaacgtccagagtatcgcggacattcatccaattcaagtccagccgggccggattcttagtcacatatatgccaagcttggacggaataagaatatgaatttgagtgggcgaccgtatcgacatattggtgtccttggaacctctaaactatatgtgattaggaaccaaatctttacttttacaccccagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcacaaatgatggctcagacattcattctgctgtgctctccacaattagaaaactagaggatggatattttggaggagccagagtaaaattagggaacctttcggaatttctcaccacatcgttctacacatatctgacttttctggatccagactgtgatgagaagttgtttgacaatgccagcgaagggactttcagtcctgatagtgattcagatttggtaggatatctggaagacacctgtaatcaagaaagccaagacgaacttgaccattatatcaaccaccttctgcaaagcacatcgttgaggtcctatctgcctcctctttgtaagaacacagaagaccgccatgtcttcagtgctatccactccacgcgggacatactttctgtgatggcaaaagcaaagggtttggaagttccatttgttcccatgactttgccgactaaagttctaagtgcccaccgtaaatcactgaatcttgttgattctcctcagccactcctagaaaaggttcctgaaagtgactttcagtggcccagagatgaccatggtgacgtggactgtgagaagctggttgagcagctaaaagattgttcgaacctacaggaccaagcagacattctgtacattctttatgtcataaagggtcccagctgggacacaaatctctctggacagcacggggtcaccgttcaaaaccttcttggtgagctctatgggaaagccggcttgaaccaggagtggggtctgattcgctacatctcaggccttctcaggaagaaagtggaggtcctggctgaggcctgcacagacctgctttcgcaccagaagcagctcaccgtgggcctgccgcccgagccccgggagaagatcatctctgcgccccttcccccagaggagctcacaaaactcatctacgaggccagtgggcaggacatcagcattgccgtcctcacgcaggagattgtggtttacctggccatgtatgtcagggcgcagcccagcctctttgtggagatgctgagactccggattggactgatcattcaggtgatggccacggagctggcacggagcctgaactgctcaggagaagaggcttctgaaagtttgatgaacctcagccctttcgatatgaaaaatctcctgcaccatattctaagtgggaaagagtttggcgttgaaagaagtgtgcgccctatccactcctccacatccagccctaccatctccatccacgaggtgggccataccggagtcaccaaaactgagaggagtggcattaacagactgaggagtgaaatgaaacagatgactaggcggtttagtgctgatgaacagttcttttctgtgggccaggccgcgtccagcagtgcgcattcctccaagtctgcgaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggacttccacaggcccagggactcgaggggtggggctccattaggagatcagtcggggcatggtgaaggggaggagaggttgtcaaggctcagctgcctggacagagaggatggaaatactccctgtgtgaaaaaagaaaaggaaaagaccccagatcaggaggcaggaaatgcagtttggcagagttggttgatgccacttacttctggacaagaagactggaggcttggccacccttgatggaaattgcagcagaaccatctctctattctgttgattcccgcaccaggctggcaaatagcttttgtcttttctgcttccttgttgcaaaagggtacaaaagcctcccacccaccccacccccaatcgccctttgtgccattatctttcaaggtgacttagcttttgaagtccctgccatctgctctgcaggcctgtactttgcaggatgtgagagcaccgcgttcccagaatgccttctgttctacccgacgtggctactgatagctctgcctgtgaggggaaaagaaagctgcgctgtggcccccttaaagcccagtccctgctgtctccctcaaaaagccacttaggaaagccacggccttgaggtaccaagagagttctttgagaaatgagagtggaaactgtgagagaggctgctctgcagtcgagtgctgggcacgtctgacgatgcctgggagaggaaaaaattccatcaaaaaactaccatggttttctttagaggaacatatgtgcacttttggcaaaacatgccttctcaggagagctggaatagttggaaccaa

SEQ ID NO: 420066 - DNA, 5477 bp, Homo sapiens
tcctcccttggtagccactcttgtgacaggaaggccttcttcccagccggtgaagggtcacagtgtcgttaatgttcaaagtgtagcactcatgttgcaaaattacgggatggctaccagcactcgtgcttggctaacccatacgtggtcatcttgcgcgatcattgtgactgccggaagactcttgtctagccaccgcaggaaatattcacattgtggaaaggatctgtgcccctcagggttccaaacgttccactccgcggcaggggcgggggcgagtccggagggcgggtccaaggcgcccaggtggccgcggcagaagggcctgtttctctggccttggctgtggttggcagccggccggggagagaagggactcagggaggcaacctggttcccgcccgttgctgatttcgcagcggctctcccgggccgcccccttttccttcctcctcaggccgcgacttggagggttccgctccgcggcgggggcagagccaggggcggggctgagcgcggcctgggcgatctccccggcggctggggtgggctggcgtcttcttcgcgcccgggggacctcctcgcgaccgccgggacgtaaaaggggcttggcaggggcgtcctcgccccactcccggaacctggtttcccgctgctcccgcgagcgtcgggagcccagcaggcctggccgaggcgggaccttcgtcgctccagcccccgtccccgcccccgcgcctccccgccgcgcggagctctggttggcttgctttccaaccggactttggggctagcgtttagaaaagtctcgacctcctccggcccggtcccatcccaagaaccgactaaggctgtgagtgtccgggaaccagacccgcttggaggccacagccccgacgtcccgcgcccacgcggcagatcgggcgctgcggcctgggagcctcggggagatgcggagcaggagcaattccggggtccgcttggacgggtacgcgcggctggtgcagcaaaccatcctgtgttaccagaatcccgtcacggggctgctgtcagccagccatgagcagaaggatgcctgggtgcgggataacatctacagtatcctggccgtgtggggcctgggcatggcctaccgtaagaatgcagaccgcgatgaggacaaggccaaggcctacgagctggagcagaacgtggtgaagctgatgcgaggtcttctccagtgcatgatgagacaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggcttacgtatcattttcactctcgatgaggtggccttcatacagaatcttgtcttttacatagaagctgcatataaagtcgctgattatggaatgtgggagcgtggagataagactaatcagggcatcccggaattgaatgcaagctccgtaggaatggccaaggcagctcttgaggcaattgatgaactggacctttttggagcccatggaggacgcaagtcagtgattcatgttctgccagatgaggtcgagcactgccagtctattctgttctccatgctgccaagagcgtcgacatctaaagaaattgatgctggacttctttccattatttccttcccggcctttgcagtggaagatgtaaaccttgtaaatgtgaccaaaaatgaaattatttctaagctccaggggcgttatggatgctgtcgcttccttcgagatggttataaaactccaagagaggaccctaatcgactgcattatgaccctgctgaactcaagctcttcgaaaacattgaatgtgagtggcctgtgttttggacatattttataatagatggagtcttcagtggtgatgctgttcaggtccaagaataccgagaggccctggagggaatactcatcagaggcaagaatgggatccgcctggtgcctgaactctacgctgtcccgcctaacaaggtagatgaagagtacaagaatcctcacacagtagaccgagttcctatggggaaggtgcctcatctgtggggccaatccttgtacatcctcagctcgctgttggcagagggattccttgccgctggtgaaatcgatcccttaaatagaagattttccacttcagtcaaacctgatgttgtagtacaagttactgttttggcagaaaacaatcacattaaggacttattgaggaaacacggggtgaacgtccagagtatcgcggacattcatccaattcaagtccagccgggccggattcttagtcacatatatgccaagcttggacggaataagaatatgaatttgagtgggcgaccgtatcgacatattggtgtccttggaacctctaaactatatgtgattaggaaccaaatctttacttttacaccccagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcacaaatgatggctcagacattcattctgctgtgctctccacaattagaaaactagaggatggatattttggaggagccagagtaaaattagggaacctttcggaatttctcaccacatcgttctacacatatctgacttttctggatccagactgtgatgagaagttgtttgacaatgccagcgaagggactttcagtcctgatagtgattcagatttggtaggatatctggaagacacctgtaatcaagaaagccaagacgaacttgaccattatatcaaccaccttctgcaaagcacatcgttgaggtcctatctgcctcctctttgtaagaacacagaagaccgccatgtcttcagtgctatccactccacgcgggacatactttctgtgatggcaaaagcaaagggtttggaagttccatttgttcccatgactttgccgactaaagttctaagtgcccaccgtaaatcactgaatcttgttgattctcctcagccactcctagaaaaggttcctgaaagtgactttcagtggcccagagatgaccatggtgacgtggactgtgagaagctggttgagcagctaaaagattgttcgaacctacaggaccaagcagacattctgtacattctttatgtcataaagggtcccagctgggacacaaatctctctggacagcacggggtcaccgttcaaaaccttcttggtgagctctatgggaaagccggcttgaaccaggagtggggtctgattcgctacatctcaggccttctcaggaagaaagtggaggtcctggctgaggcctgcacagacctgctttcgcaccagaagcagctcaccgtgggcctgccgcccgagccccgggagaagatcatctctgcgccccttcccccagaggagctcacaaaactcatctacgaggccagtgggcaggacatcagcattgccgtcctcacgcaggagattgtggtttacctggccatgtatgtcagggcgcagcccagcctctttgtggagatgctgagactccggattggactgatcattcaggtgatggccacggagctggcacggagcctgaactgctcaggagaagaggcttctgaaagtttgatgaacctcagccctttcgatatgaaaaatctcctgcaccatattctaagtgggaaagagtttggcgttgaaagaagtgtgcgccctatccactcctccacatccagccctaccatctccatccacgaggtgggccataccggagtcaccaaaactgagaggagtggcattaacagactgaggagtgaaatgaaacagatgactaggcggtttagtgctgatgaacagttcttttctgtgggccaggccgcgtccagcagtgcgcattcctccaagtctgcgaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgggggtgccagggagctgggttggctggcatttatctctgttgaggctggagattcctgaaactgatgtatgttaaagccacagagatagagctgaggagtcctgtgttcccccgcaaggagcaccccgggatcattttctaggttcatttctctggaacatttgctgtagcatctggtctcacggacttccacaggcccagggactcgaggggtggggctccattaggagatcagtcggggcatggtgaaggggaggagaggttgtcaaggctcagctgcctggacagagaggatggaaatactccctgtgtgaaaaaagaaaaggaaaagaccccagatcaggaggcaggaaatgcagtttggcagagttggttgatgccacttacttctggacaagaagactggaggcttggccacccttgatggaaattgcagcagaaccatctctctattctgttgattcccgcaccaggctggcaaatagcttttgtcttttctgcttccttgttgcaaaagggtacaaaagcctcccacccaccccacccccaatcgccctttgtgccattatctttcaaggtgacttagcttttgaagtccctgccatctgctctgcaggcctgtactttgcaggatgtgagagcaccgcgttcccagaatgccttctgttctacccgacgtggctactgatagctctgcctgtgaggggaaaagaaagctgcgctgtggcccccttaaagcccagtccctgctgtctccctcaaaaagccacttaggaaagccacggccttgaggtaccaagagagttctttgagaaatgagagtggaaactgtgagagaggctgctctgcagtcgagtgctgggcacgtctgacgatgcctgggagaggaaaaaattccatcaaaaaactaccatggttttctttagaggaacatatgtgcacttttggcaaaacatgccttctcaggagagctggaatagttggaaccaa

SEQ ID NO: 420067 - DNA, 4577 bp, Homo sapiens
tcctcccttggtagccactcttgtgacaggaaggccttcttcccagccggtgaagggtcacagtgtcgttaatgttcaaagtgtagcactcatgttgcaaaattacgggatggctaccagcactcgtgcttggctaacccatacgtggtcatcttgcgcgatcattgtgactgccggaagactcttgtctagccaccgcaggaaatattcacattgtggaaaggatctgtgcccctcagggttccaaacgttccactccgcggcaggggcgggggcgagtccggagggcgggtccaaggcgcccaggtggccgcggcagaagggcctgtttctctggccttggctgtggttggcagccggccggggagagaagggactcagggaggcaacctggttcccgcccgttgctgatttcgcagcggctctcccgggccgcccccttttccttcctcctcaggccgcgacttggagggttccgctccgcggcgggggcagagccaggggcggggctgagcgcggcctgggcgatctccccggcggctggggtgggctggcgtcttcttcgcgcccgggggacctcctcgcgaccgccgggacgtaaaaggggcttggcaggggcgtcctcgccccactcccggaacctggtttcccgctgctcccgcgagcgtcgggagcccagcaggcctggccgaggcgggaccttcgtcgctccagcccccgtccccgcccccgcgcctccccgccgcgcggagctctggttggcttgctttccaaccggactttggggctagcgtttagaaaagtctcgacctcctccggcccggtcccatcccaagaaccgactaaggctgtgagtgtccgggaaccagacccgcttggaggccacagccccgacgtcccgcgcccacgcggcagatcgggcgctgcggcctgggagcctcggggagatgcggagcaggagcaattccggggtccgcttggacgggtacgcgcggctggtgcagcaaaccatcctgtgttaccagaatcccgtcacggggctgctgtcagccagccatgagcagaaggatgcctgggtgcgggataacatctacagtatcctggccgtgtggggcctgggcatggcctaccgtaagaatgcagaccgcgatgaggacaaggccaaggcctacgagctggagcagaacgtggtgaagctgatgcgaggtcttctccagtgcatgatgagacaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggcttacgtatcattttcactctcgatgaggtggccttcatacagaatcttgtcttttacatagaagctgcatataaagtcgctgattatggaatgtgggagcgtggagataagactaatcagggcatcccggaattgaatgcaagctccgtaggaatggccaaggcagctcttgaggcaattgatgaactggacctttttggagcccatggaggacgcaagtcagtgattcatgttctgccagatgaggtcgagcactgccagtctattctgttctccatgctgccaagagcgtcgacatctaaagaaattgatgctggacttctttccattatttccttcccggcctttgcagtggaagatgtaaaccttgtaaatgtgaccaaaaatgaaattatttctaagctccaggggcgttatggatgctgtcgcttccttcgagatggttataaaactccaagagaggaccctaatcgactgcattatgaccctgctgaactcaagctcttcgaaaacattgaatgtgagtggcctgtgttttggacatattttataatagatggagtcttcagtggtgatgctgttcaggtccaagaataccgagaggccctggagggaatactcatcagaggcaagaatgggatccgcctggtgcctgaactctacgctgtcccgcctaacaaggtagatgaagagtacaagaatcctcacacagtagaccgagttcctatggggaaggtgcctcatctgtggggccaatccttgtacatcctcagctcgctgttggcagagggattccttgccgctggtgaaatcgatcccttaaatagaagattttccacttcagtcaaacctgatgttgtagtacaagttactgttttggcagaaaacaatcacattaaggacttattgaggaaacacggggtgaacgtccagagtatcgcggacattcatccaattcaagtccagccgggccggattcttagtcacatatatgccaagcttggacggaataagaatatgaatttgagtgggcgaccgtatcgacatattggtgtccttggaacctctaaactatatgtgattaggaaccaaatctttacttttacaccccagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcacaaatgatggctcagacattcattctgctgtgctctccacaattagaaaactagaggatggatattttggaggagccagagtaaaattagggaacctttcggaatttctcaccacatcgttctacacatatctgacttttctggatccagactgtgatgagaagttgtttgacaatgccagcgaagggactttcagtcctgatagtgattcagatttggtaggatatctggaagacacctgtaatcaagaaagccaagacgaacttgaccattatatcaaccaccttctgcaaagcacatcgttgaggtcctatctgcctcctctttgtaagaacacagaagaccgccatgtcttcagtgctatccactccacgcgggacatactttctgtgatggcaaaagcaaagggtttggaagttccatttgttcccatgactttgccgactaaagttctaagtgcccaccgtaaatcactgaatcttgttgattctcctcagccactcctagaaaaggttcctgaaagtgactttcagtggcccagagatgaccatggtgacgtggactgtgagaagctggttgagcagctaaaagattgttcgaacctacaggaccaagcagacattctgtacattctttatgtcataaagggtcccagctgggacacaaatctctctggacagcacggggtcaccgttcaaaaccttcttggtgagctctatgggaaagccggcttgaaccaggagtggggtctgattcgctacatctcaggccttctcaggaagaaagtggaggtcctggctgaggcctgcacagacctgctttcgcaccagaagcagctcaccgtgggcctgccgcccgagccccgggagaagatcatctctgcgccccttcccccagaggagctcacaaaactcatctacgaggccagtgggcaggacatcagcattgccgtcctcacgcaggagattgtggtttacctggccatgtatgtcagggcgcagcccagcctctttgtggagatgctgagactccggattggactgatcattcaggtgatggccacggagctggcacggagcctgaactgctcaggagaagaggcttctgaaagtttgatgaacctcagccctttcgatatgaaaaatctcctgcaccatattctaagtgggaaagagtttggcgttgaaagaagtgtgcgccctatccactcctccacatccagccctaccatctccatccacgaggtgggccataccggagtcaccaaaactgagaggagtggcattaacagactgaggagtgaaatgaaacagatgactaggcggtttagtgctgatgaacagttcttttctgtgggccaggccgcgtccagcagtgcgcattcctccaagtctgcgaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgggggtgccagggagctgggttggctggcatttatctctgttgaggctggagattctgtgtccaataggaaagaatatactcgaaccaaga

SEQ ID NO: 420068 - DNA, 4550 bp, Homo sapiens
tcctcccttggtagccactcttgtgacaggaaggccttcttcccagccggtgaagggtcacagtgtcgttaatgttcaaagtgtagcactcatgttgcaaaattacgggatggctaccagcactcgtgcttggctaacccatacgtggtcatcttgcgcgatcattgtgactgccggaagactcttgtctagccaccgcaggaaatattcacattgtggaaaggatctgtgcccctcagggttccaaacgttccactccgcggcaggggcgggggcgagtccggagggcgggtccaaggcgcccaggtggccgcggcagaagggcctgtttctctggccttggctgtggttggcagccggccggggagagaagggactcagggaggcaacctggttcccgcccgttgctgatttcgcagcggctctcccgggccgcccccttttccttcctcctcaggccgcgacttggagggttccgctccgcggcgggggcagagccaggggcggggctgagcgcggcctgggcgatctccccggcggctggggtgggctggcgtcttcttcgcgcccgggggacctcctcgcgaccgccgggacgtaaaaggggcttggcaggggcgtcctcgccccactcccggaacctggtttcccgctgctcccgcgagcgtcgggagcccagcaggcctggccgaggcgggaccttcgtcgctccagcccccgtccccgcccccgcgcctccccgccgcgcggagctctggttggcttgctttccaaccggactttggggctagcgtttagaaaagtctcgacctcctccggcccggtcccatcccaagaaccgactaaggctgtgagtgtccgggaaccagacccgcttggaggccacagccccgacgtcccgcgcccacgcggcagatcgggcgctgcggcctgggagcctcggggagatgcggagcaggagcaattccggggtccgcttggacgggtacgcgcggctggtgcagcaaaccatcctgtgttaccagaatcccgtcacggggctgctgtcagccagccatgagcagaaggatgcctgggtgcgggataacatctacagtatcctggccgtgtggggcctgggcatggcctaccgtaagaatgcagaccgcgatgaggacaaggccaaggcctacgagctggagcagaacgtggtgaagctgatgcgaggtcttctccagtgcatgatgagacaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggcttacgtatcattttcactctcgatgaggtggccttcatacagaatcttgtcttttacatagaagctgcatataaagtcgctgattatggaatgtgggagcgtggagataagactaatcagggcatcccggaattgaatgcaagctccgtaggaatggccaaggcagctcttgaggcaattgatgaactggacctttttggagcccatggaggacgcaagtcagtgattcatgttctgccagatgaggtcgagcactgccagtctattctgttctccatgctgccaagagcgtcgacatctaaagaaattgatgctggacttctttccattatttccttcccggcctttgcagtggaagatgtaaaccttgtaaatgtgaccaaaaatgaaattatttctaagctccaggggcgttatggatgctgtcgcttccttcgagatggttataaaactccaagagaggaccctaatcgactgcattatgaccctgctgaactcaagctcttcgaaaacattgaatgtgagtggcctgtgttttggacatattttataatagatggagtcttcagtggtgatgctgttcaggtccaagaataccgagaggccctggagggaatactcatcagaggcaagaatgggatccgcctggtgcctgaactctacgctgtcccgcctaacaaggtagatgaagagtacaagaatcctcacacagtagaccgagttcctatggggaaggtgcctcatctgtggggccaatccttgtacatcctcagctcgctgttggcagagggattccttgccgctggtgaaatcgatcccttaaatagaagattttccacttcagtcaaacctgatgttgtagtacaagttactgttttggcagaaaacaatcacattaaggacttattgaggaaacacggggtgaacgtccagagtatcgcggacattcatccaattcaagtccagccgggccggattcttagtcacatatatgccaagcttggacggaataagaatatgaatttgagtgggcgaccgtatcgacatattggtgtccttggaacctctaaactatatgtgattaggaaccaaatctttacttttacaccccagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcacaaatgatggctcagacattcattctgctgtgctctccacaattagaaaactagaggatggatattttggaggagccagagtaaaattagggaacctttcggaatttctcaccacatcgttctacacatatctgacttttctggatccagactgtgatgagaagttgtttgacaatgccagcgaagggactttcagtcctgatagtgattcagatttggtaggatatctggaagacacctgtaatcaagaaagccaagacgaacttgaccattatatcaaccaccttctgcaaagcacatcgttgaggtcctatctgcctcctctttgtaagaacacagaagaccgccatgtcttcagtgctatccactccacgcgggacatactttctgtgatggcaaaagcaaagggtttggaagttccatttgttcccatgactttgccgactaaagttctaagtgcccaccgtaaatcactgaatcttgttgattctcctcagccactcctagaaaaggttcctgaaagtgactttcagtggcccagagatgaccatggtgacgtggactgtgagaagctggttgagcagctaaaagattgttcgaacctacaggaccaagcagacattctgtacattctttatgtcataaagggtcccagctgggacacaaatctctctggacagcacggggtcaccgttcaaaaccttcttggtgagctctatgggaaagccggcttgaaccaggagtggggtctgattcgctacatctcaggccttctcaggaagaaagtggaggtcctggctgaggcctgcacagacctgctttcgcaccagaagcagctcaccgtgggcctgccgcccgagccccgggagaagatcatctctgcgccccttcccccagaggagctcacaaaactcatctacgaggccagtgggcaggacatcagcattgccgtcctcacgcaggagattgtggtttacctggccatgtatgtcagggcgcagcccagcctctttgtggagatgctgagactccggattggactgatcattcaggtgatggccacggagctggcacggagcctgaactgctcaggagaagaggcttctgaaagtttgatgaacctcagccctttcgatatgaaaaatctcctgcaccatattctaagtgggaaagagtttggcgttgaaagaagtgatacgaggtctcaccatgctgcccaggctggtcttgaactcctgggctcaagcagtcttcccacctcggcctcccaaagtgctgggattacaggtgtgagccaccgtgcctggcctcggtgcgccctatccactcctccacatccagccctaccatctccatccacgaggtgggccataccggagtcaccaaaactgagaggagtggcattaacagactgaggagtgaaatgaaacaggtaagaacacctcagtggcagcgagggatgagtggtggtctccctacctgggcttaccccagaaagcgacagaaacctagggcatgaggctgcagcccactgtctgtagagtgggaggtcccttctgtctgggatctgaacacacccctgtccccagatagatattccagagccggtcatgcgcacccttacccactcatccttaaccttaacgtgatgttctcatgaacgttccagaaaatacccttgtccatgtttgcctctgttcccgagaaccactcttaggagtgggccacagccattgaaaaagtagagtcatgcaaaaagtcaccgaatcatctgtgtccttcaaacgaaatagcaagagggctctggaaatagaccagaatgcccatgatacttggattctccaccagccacaggggtctcttttcttagttcacctttaattcctggt

SEQ ID NO: 420069 - DNA, 2878 bp, Homo sapiens
tcctcccttggtagccactcttgtgacaggaaggccttcttcccagccggtgaagggtcacagtgtcgttaatgttcaaagtgtagcactcatgttgcaaaattacgggatggctaccagcactcgtgcttggctaacccatacgtggtcatcttgcgcgatcattgtgactgccggaagactcttgtctagccaccgcaggaaatattcacattgtggaaaggatctgtgcccctcagggttccaaacgttccactccgcggcaggggcgggggcgagtccggagggcgggtccaaggcgcccaggtggccgcggcagaagggcctgtttctctggccttggctgtggttggcagccggccggggagagaagggactcagggaggcaacctggttcccgcccgttgctgatttcgcagcggctctcccgggccgcccccttttccttcctcctcaggccgcgacttggagggttccgctccgcggcgggggcagagccaggggcggggctgagcgcggcctgggcgatctccccggcggctggggtgggctggcgtcttcttcgcgcccgggggacctcctcgcgaccgccgggacgtaaaaggggcttggcaggggcgtcctcgccccactcccggaacctggtttcccgctgctcccgcgagcgtcgggagcccagcaggcctggccgaggcgggaccttcgtcgctccagcccccgtccccgcccccgcgcctccccgccgcgcggagctctggttggcttgctttccaaccggactttggggctagcgtttagaaaagtctcgacctcctccggcccggtcccatcccaagaaccgactaaggctgtgagtgtccgggaaccagacccgcttggaggccacagccccgacgtcccgcgcccacgcggcagatcgggcgctgcggcctgggagcctcggggagatgcggagcaggagcaattccggggtccgcttggacgggtacgcgcggctggtgcagcaaaccatcctgtgttaccagaatcccgtcacggggctgctgtcagccagccatgagcagaaggatgcctgggtgcgggataacatctacagtatcctggccgtgtggggcctgggcatggcctaccgtaagaatgcagaccgcgatgaggacaaggccaaggcctacgagctggagcagaacgtggtgaagctgatgcgaggtcttctccagtgcatgatgagacaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggcttacgtatcattttcactctcgatgaggtggccttcatacagaatcttgtcttttacatagaagctgcatataaagtcgctgattatggaatgtgggagcgtggagataagactaatcagggcatcccggaattgaatgcaagctccgtaggaatggccaaggcagctcttgaggcaattgatgaactggacctttttggagcccatggaggacgcaagtcagtgattcatgttctgccagatgaggtcgagcactgccagtctattctgttctccatgctgccaagagcgtcgacatctaaagaaattgatgctggacttctttccattatttccttcccggcctttgcagtggaagatgtaaaccttgtaaatgtgaccaaaaatgaaattatttctaagctccaggggcgttatggatgctgtcgcttccttcgagatggttataaaactccaagagaggaccctaatcgactgcattatgaccctgctgaactcaagctcttcgaaaacattgaatgtgagtggcctgtgttttggacatattttataatagatggagtcttcagtggtgatgctgttcaggtccaagaataccgagaggccctggagggaatactcatcagaggcaagaatgggatccgcctggtgcctgaactctacgctgtcccgcctaacaaggtagatgaagagtacaagaatcctcacacagtagaccgagttcctatggggaaggtgcctcatctgtggggccaatccttgtacatcctcagctcgctgttggcagagggattccttgccgctggtgaaatcgatcccttaaatagaagattttccacttcagtcaaacctgatgttgtagtacaagttactgttttggcagaaaacaatcacattaaggacttattgaggaaacacggggtgaacgtccagagtatcgcggacattcatccaattcaagtccagccgggccggattcttagtcacatatatgccaagcttggacggaataagaatatgaatttgagtgggcgaccgtatcgacatattggtgtccttggaacctctaaactatatgtgattaggaaccaaatctttacttttacaccccagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcagtaactccagggatttcagcaggctccctcctgccccaggggtggtttgggctcttacaaatgtttaaaatggctcccatggccagaactaagcactgaaggggcttcttagcagtttggtttcttatctcgggaatcttctatgccagaaatattttaattagatggtgttgatgaaaatgtttcagtgcataacggaaaaaaagtctgcccagac

SEQ ID NO: 420070 - DNA, 110 bp, Homo sapiens
gtgacacccctttgccttgttcgtcctttacttcctgttctttctggcttgaatgtggaaagtgaggctgtgactccgcagcgtgtgaatgtgtagagggcggctctatc

SEQ ID NO: 420071 - DNA, 820 bp, Homo sapiens
tgaaatgcgctctattctgcctccagtgccacggtctctccatcgatggttatgtcctcccatcctcgacgacccgagaggtacgatgagaaaaacgcagaggcgggcccctctgtgggttcacaataagggcttcattgcatggactctgacctcttgtgctccttttgggctcattctaattgacaggccatttgtagctctgagctgtctagccccttcaccctcatatttggcaaaaatgtctttccagcatttattggcatcagcctttttcttcacctgagactcagcatttctgggctagcaagctctttgcatttgccagacaccccttagaaccctggtgaaagaaaggagccaatctccatgccaccctggcctgccccatgggcagccttctcggcccttttctccaactaaaaacagtaatcgtccctaggtgatttgtcattctttttaacatggatttttttttagttttaccccacccaaagcaccatgcttcatgctggaaggaataatgaagaggaaagagaaaccagaaatggtccctgctccctggaagctgtagtcgatggggggaagggtagataaatcaggcgaggacaggctggctcctggaggcatactccagcctcctgctctgagggccactgccagcaggatccagggagtggccagaaaaggggcagcagtggcgctgagccccgagcccaggcactgctacggtcacccttggttactcggtgattgattgatagggctgcatctgtcctctcactggtggttgcctgcctgtccctttggtagatgaccc

SEQ ID NO: 420072 - DNA, 391 bp, Homo sapiens
tactctgcacacttccgtttactcctttaagagctgagtgctgcacctgtgctgctctcggtgctggagacacagcgctggccaggcagagaaggccctcattgtcaagtgggggagacaggggcagatcctgcctcgggttggatgctgtagagttcctgagaaccacgtgtgtgtgtttcccacccagtgcgccctatccactcctccacatccagccctaccatctccatccacgaggtgggccataccggagtcaccaaaactgagaggagtggcattaacagactgaggagtgaaatgaaacaggtaagaacacctcagtggcagcgagggatgagtggtggtctccctacctgggcttaccccagaaagcgacagaaacctaggg

SEQ ID NO: 420073 - DNA, 468 bp, Homo sapiens
cttctggactaaaatccttgctctgttggaaccttccccgcatcaatccaacctgtaccagaggtcccaaatctctctcatccctttctactcataggcacacacaggaaagtggagcccttcctttccttctccttattttccttccttccctccttccttccctcttttcggagattagacactcactgttatgccttacttaagacttcatttttgatgcctttggaagaaaaatgaaaatgagggtaaaagggtttatttcctagtgtgatatttgtaatttgtgactggcagctctctgcaacatggcttcataacctcattgtttttctttgctaggcttacgtatcattttcactctcgatgaggtggccttcatacagaatcttgtcttttacatagaagctgcatataaagtcgctgtaagtatcaaccctggtagtcttttcagatgttccagtcaac

SEQ ID NO: 420074 - DNA, 1569 bp, Homo sapiens
atcgtgcataagatcaccttatcgtgcagaagatcacctcatcgtgcagaagatcacttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaacaacatctactcttccccattacaaccccggcgctgtccctactcgcaaccatcatcttaacaaaaa

SEQ ID NO: 420075 - DNA, 2241 bp, Homo sapiens
gaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggtacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaacaacatctactcttccccattacaaccccggcgctgtccctactcgcaaccatcatcttaacaaaaa

SEQ ID NO: 420076 - DNA, 1497 bp, Homo sapiens
  misc_feature (1462)..(1462): n is a, c, g, or t
  misc_feature (1465)..(1465): n is a, c, g, or t
gaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggtacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaggcaaagggccnggntccttcgggaaggcactccgggcgaattggtt

SEQ ID NO: 420077 - DNA, 1990 bp, Homo sapiens
acctgagtctgggcgggagggcgagagcgagggcgcctgggagaaacctcgcccagcggcggttgattagtcaggcctcagaaagatggcgtcctcggagcaggcagagcagccgagccagccaagctctactccaggaagtgaaaatgtgctgcctcgagagccgctgattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacagtgactcagttacagacgaccctcgcctccgtccaggagctgctgattcagcagcagcagaagatccaggagcttgcccacgagctggccgctgccaaggccaccacatccaccaactggatcctggagtcccagaatatcaacgaactcaagtccgaaattaactccttgaaagggcttcttttaaatcggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggcccccaggaggaaggcgagggggtggtggacgtcaagggccaggtgcggatggaggtgcaaggcgaggaggagaagagggaggacaaggaggacgaggaggatgaggaggatgatgatgtgagccatgtggacgaggaggactgcctgggggtgcagagggaggaccgccggggcggggatgggcagatcaacgagcaggtggagaagctgcggcggcccgagggcgccagcaacgagagtgagcgggactagggctgcgcctgctgcctccagccctgaggatggcatctagtgtgcccgtgcgtggccataccctgcctccctctctggccctgggagggcagcttggagcccaggtagggggcagagctgtcctcagctgcactgcggcctggtggcagtgtggggagtcacacttctgtccacctggcctcctctcgcctggccgccagccccagccccagccccagccccaggcccagctgcctttggctttgatctcaagtcaggctgaaggcagcgaagcctcggggcccaagcccctccccagccccctctcccggacagacgccttgcccagggtgtgtttgctgagtgtcttgactaccgtgacaccacgcatggccagagctagcgtccctactgcctcccgactcctcagtggaggaggagctgcggtccctctggtgtctgccatccccctccctccctgggcccggccctggacccgtcaggtgcctgtccccagccccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaa

SEQ ID NO: 420078 - DNA, 993 bp, Homo sapiens
aattatgtcttcaattatatggtacacagtacaggcactgaagaattgaagagaatagggagatcagagatggcttgcttatttaggcaaggcttcgaggaatcagaacagactataaaagggctgtgctgatagagaacgtgtgtgtgtgtgtgtgcgtgtgtacgtgcgcgtggggtaacgtttagacaggtggaggcaggaaagggaggccttccagaaagacagcatacagggcacaagggcggcgacatgggtgcgcatggccacacctgccggggagtatgaagaatcagctcgaatggagatcaggaggaacaggaaggatcgtcgcaggcctgaagctcggcagagggattagatttgacagactcagatacaggaagccagtgaagacagggaaacaacatcgcctttcatttagattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacaggtaaagattaatgactccatcaagtcacccctcacagccttctccaagcagccccttctctgcccctcccctctccctctgtctccactctatgtggtgacttcatttatctgctctgagaatctgttcacatttgcaaatgaagccgccgtcatttcggtttaat

SEQ ID NO: 420079 - DNA, 158 bp, Homo sapiens
gttggtcaggaaacaaatgaacatgtgtttcctggggggaaggacagagctggctgttggtcaggaaacacatgttcatttgtgtgatcatgtatagacctcagaacggaagataggactgtatataattgtaataaataccagttgccactatttaa

SEQ ID NO: 420080 - DNA, 2027 bp, Homo sapiens
  misc_feature (2011)..(2011): n is a, c, g, or t
acctgagtctgggcgggagggcgagagcgagggcgcctgggagaaacctcgcccagcggcggttgattagtcaggcctcagaaagatggcgtcctcggagcaggcagagcagccgagccagccaagctctactccaggaagtgaaaatgtgctgcctcgagagccgctgattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacagtgactcagttacagacgaccctcgcctccgtccaggagctgctgattcagcagcagcagaagatccaggagcttgcccacgagctggccgctgccaaggccaccacatccaccaactggatcctggagtcccagaatatcaacgaactcaagtccgaaattaactccttgaaagggcttcttttaaatcggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggcccccaggaggaaggcgagggggtggtggacgtcaagggccaggtgcggatggaggtgcaaggcgaggaggagaagagggaggacaaggaggacgaggaggatgaggaggatgatgatgtgagccatgtggacgaggaggactgcctgggggtgcagagggaggaccgccggggcggggatgggcagatcaacgagcaggtggagaagctgcggcggcccgagggcgccagcaacgagagtgagcgggactagggctgcgcctgctgcctccagccctgaggatggcatctagtgtgcccgtgcgtggccataccctgcctccctctctggccctgggagggcagcttggagcccaggtagggggcagagctgtcctcagctgcactgcggcctggtggcagtgtggggagtcacacttctgtccacctggcctcctctcgcctggccgccagccccagccccagccccagccccaggcccagctgcctttggctttgatctcaagtcaggctgaaggcagcgaagcctcggggcccaagcccctccccagccccctctcccggacagacgccttgcccagggtgtgtttgctgagtgtcttgactaccgtgacaccacgcatggccagagctagcgtccctactgcctcccgactcctcagtggaggaggagctgcggtccctctggtgtctgccatccccctccctccctgggcccggccctggacccgtcaggtgcctgtccccagccccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaaaaaaaaaaaaaaaaaaaaaanaacaaaaaaaaaaggg

SEQ ID NO: 420081 - DNA, 1661 bp, Homo sapiens
acctgagtctgggcgggagggcgagagcgagggcgcctgggagaaacctcgcccagcggcggttgattagtcaggcctcagaaagatggcgtcctcggagcaggcagagcagccgagccagccaagctctactccaggaagtgaaaatgtgctgcctcgagagccgctgattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacagtgactcagttacagacgaccctcgcctccgtccaggagctgctgattcagcagcagcagaagatccaggagcttgcccacgagctggccgctgccaaggccaccacatccaccaactggatcctggagtcccagaatatcaacgaactcaagtccgaaattaactccttgaaagggcttcttttaaatcggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggcccccaggaggaaggcgagggggtggtggacgtcaagggccaggtgcggatggaggtgcaaggcgaggaggagaagagggaggacaaggaggacgaggaggatgaggaggatgatgatgtgagccatgtggacgaggaggactgcctgggggtgcagagggaggaccgccggggcggggatgggcagatcaacgagcaggtggagaagctgcggcgccccagccccctctcccggacagacgccttgcccagggtgtgtttgctgagtgtcttgactaccgtgacaccacgcatggccagagctagcgtccctactgcctcccgactcctcagtggaggaggagctgcggtccctctggtgtctgccatccccctccctccctgggcccggccctggacccgtcaggtgcctgtccccagccccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaa

SEQ ID NO: 420082 - DNA, 1785 bp, Homo sapiens
acctgagtctgggcgggagggcgagagcgagggcgcctgggagaaacctcgcccagcggcggttgattagtcaggcctcagaaagatggcgtcctcggagcaggcagagcagccgagccagccaagctctactccaggaagtgaaaatgtgctgcctcgagagccgctgattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacagtgactcagttacagacgaccctcgcctccgtccaggagctgctgattcagcagcagcagaagatccaggagcttgcccacgagctggccgctgccaaggccaccacatccaccaactggatcctggagtcccagaatatcaacgaactcaagtccgaaattaactccttgaaagggcttcttttaaatcggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggcccccaggaggaaggcgagggggtggtggacgtcaagggccaggtgcggatggaggtgcaaggcgaggaggagaagagggaggacaaggaggacgaggaggatgaggaggatgatgatgtgagccatgtggacgaggaggactgcctgggggtgcagagggaggaccgccggggcggggatgggcagatcaacgagcaggtggagaagctgcggcggcccgagggcgccagcaacgagagtgagcgggactagggctgcgcctgctgcctccagccctgaggatggcatctagtgtgcccgtgcgtggccataccctgcctccctctctggccctgggagggcagcttggagcccaggtagggggcagagctgtcctcagctgcactgcggcctggtggcagtgtggggagtcacacttctgtccacctggcctcctctcgcctggccgccagccccagccccagccccagccccaggcccagctgcctttggctttgatctcaagtcaggctgaaggcagcgaagcctcggggcccaagcccctcccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaa

SEQ ID NO: 420083 - DNA, 1924 bp, Homo sapiens
gctggtacggcctggaggtaagggatcctcggagcaggcagagcagccgagccagccaagctctactccaggaagtgaaaatgtgctgcctcgagagccgctgattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacagtgactcagttacagacgaccctcgcctccgtccaggagctgctgattcagcagcagcagaagatccaggagcttgcccacgagctggccgctgccaaggccaccacatccaccaactggatcctggagtcccagaatatcaacgaactcaagtccgaaattaactccttgaaagggcttcttttaaatcggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggcccccaggaggaaggcgagggggtggtggacgtcaagggccaggtgcggatggaggtgcaaggcgaggaggagaagagggaggacaaggaggacgaggaggatgaggaggatgatgatgtgagccatgtggacgaggaggactgcctgggggtgcagagggaggaccgccggggcggggatgggcagatcaacgagcaggtggagaagctgcggcggcccgagggcgccagcaacgagagtgagcgggactagggctgcgcctgctgcctccagccctgaggatggcatctagtgtgcccgtgcgtggccataccctgcctccctctctggccctgggagggcagcttggagcccaggtagggggcagagctgtcctcagctgcactgcggcctggtggcagtgtggggagtcacacttctgtccacctggcctcctctcgcctggccgccagccccagccccagccccagccccaggcccagctgcctttggctttgatctcaagtcaggctgaaggcagcgaagcctcggggcccaagcccctccccagccccctctcccggacagacgccttgcccagggtgtgtttgctgagtgtcttgactaccgtgacaccacgcatggccagagctagcgtccctactgcctcccgactcctcagtggaggaggagctgcggtccctctggtgtctgccatccccctccctccctgggcccggccctggacccgtcaggtgcctgtccccagccccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaa

SEQ ID NO: 420084 - DNA, 1861 bp, Homo sapiens
acctgagtctgggcgggagggcgagagcgagggcgcctgggagaaacctcgcccagcggcggttgattagtcaggcctcagaaagatggcgtcctcggagcaggcagagcagccgagccagccaagctctactccaggaagtgaaaatgtgctgcctcgagagccgctgattgccacggcagtgaagtttctacagaattcccgggtccgccagagcccacttgcaaccaggagagcattcctaaagaagaaaggtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacagtgactcagttacagacgaccctcgcctccgtccaggagctgctgattcagcagcagcagaagatccaggagcttgcccacgagctggccgctgccaaggccaccacatccaccaactggatcctggagtcccagaatatcaacgaactcaagtccgaaattaactccttgaaagggcttcttttaaatcggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggcccccaggaggaaggcgagggggtggtggacgtcaagggccaggtgcggatggaggtgcaaggcgaggaggagaagagggaggacaaggaggacgaggaggatgaggaggatgatgatgtgagccatgtggacgaggaggactgcctgggggtgcagagggaggaccgccggggcggggatgggcagatcaacgagcaggtggagaagctgcggcggcccgagggcgccagcaacgagagtgagcgggactagggctgcgcctgctgcctccagccctgaggatggcatctagtgtgcccgtgcgtggccataccctgcctccctctctggccctgggagggcagcttggagcccaggtagggggcagagctgtcctcagctgcactgcggcctggtggcagtgtggggagtcacacttctgtccacctggcctcctctcgcctggccgccagccccagccccagccccagccccaggcccagctgcctttggctttgatctcaagtcaggctgaaggcagcgaagcctcggggcccaagcccctccccagccccctctcccggacagacgccttgcccagggtgtgtttgctgagtgtcttgactaccgtgacaccacgcatggccagagctagcgtccctactgcctcccgactcctcagtggaggaggagctgcggtccctctggtgtctgccatccccctccctccctgggcccggccctggacccgtcaggtgcctgtccccagccccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaa

SEQ ID NO: 420085 - DNA, 1285 bp, Homo sapiens
acctgagtctgggcgggagggcgagagcgagggcgcctgggagaaacctcgcccagcggcggttgattagtcaggcctcagaaagatggcgtcctcggagcaggcagagcagccgagccagccaagctctactccaggaagtgaaaatgtgctgcctcgagagccgctgattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacagtgactcagttacagacgaccctcgcctccgtccaggagctgctgattcagcagcagcagaagatccaggagcttgcccacgagctggccgctgccaaggccaccacatccaccaactggatcctggagtcccagaatatcaacgaactcaagtccgaaattaactccttgaaagggcttcttttaaatcggaggcagttccctccatccccatcagccccgaagatcccctcctggcagatcccagtcaagtcaccgtcaccctccagccctgcggccgtgaaccaccacgcatggccagagctagcgtccctactgcctcccgactcctcagtggaggaggagctgcggtccctctggtgtctgccatccccctccctccctgggcccggccctggacccgtcaggtgcctgtccccagcctctcccggacagacgccttgcccagggtgtgtttgctgagtgtcttgactacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaa

SEQ ID NO: 420086 - DNA, 532 bp, Homo sapiens
  misc_feature (516)..(516): n is a, c, g, or t
cgcaagcaccaaccaacaagaaacgctagaagctggttgaatcggacgaggcggagcaggcagagcagccgagccagaccgagtctcactctgttgaccaggctggagtgcagtggcgcgatctcggcttactgcaacctccgcctcccaggttcaagtgattctcctgcctcagcctcccaagtagctggggctacagccaagctctactccaggaagtgaaaatgtgctgcctcgagagccgctgggacttgctgtgctgctcaggctggagtgcagtgtgcaaacacggcttactgcagccttcaccttccggccgaagtgatcctcccgcctcgacctccatgtagctgggaccatagatgtgtgccaccacacccagctcatttgaaatttttgttgttgttgttgaacagaagtggtgagagtaaaataaaaataaattaaataaataatatgttttggtaaaaaaaaaagaaaaaaaacagaaaaaacaaaaaaaaaaaaaaaaaaaanaacaaaaaaaaaaggg

SEQ ID NO: 420087 - DNA, 1220 bp, Homo sapiens
acctgagtctgggcgggagggcgagagcgagggcgcctgggagaaacctcgcccagcggcggttgattagtcaggcctcagaaagatggcgtcctcggagcaggcagagcagccgagccagccaagctctactccaggaagtgaaaatgtgctgcctcgagagccgctgatggaattttgctcgtatcgcccaagctggagtgcgtggcgcgatctcagcacactgcaacctctgcttcccaggttcaagtgattctcctgcctctgcctcccaagtagctgggattacaggtgccaccatgcccggctaatttttgtatttttagtagagggggtttcaccaggctggtctttaacccctgacctcaggtggtccacctgcctcagcctcctaaagctctaggattacaggcgtgagccaccacacccagcctaattgctgtatctttattatcaactttaatatgtacaagagcaaggctcacttcatcattcttctctttaaaaaacattctgaggccgagcgcagtggctcacgcctgtaatgccagcattttgggaggcagaggcaggtggataacagatggtcttgatctcctgacctggtgatctgctatacccagcctggacacagtattttaaaaatatagtttgaaggtactggagagccaccaaaagcaagcagaaattggagtgaatttgattcttgaaagaaagaccccacccaggggagccacctttataaggctttttccttgaggtattccccaatccatcaggtgctagcaaatagaactcaagcagaaagctgtgtcatattggtttgaggaatcaggggatattttgagactgtgtgtcgggaaattgaagatggcaatcatagaaaggagagaaccatgctggggatcaccccgaagtacatataaacacccctcacatgctagactaactgctgaactgcccatgcacaggggaagtgccacagattccagcagagatttcagtagctgcctgctgtgggagagagagaatttggaggtggagtcttgtcaagttagaggcgattcgataaacaccttggactttgctttgaaatcccagaagggctaccccttaggggcaaatactactccccagggctatggcattttccctaggactaagggcaaaacaaaaataaagcataaaattgtgcctacaccagatctacaggtgattta

SEQ ID NO: 420088 - DNA, 388 bp, Homo sapiens
  misc_feature (372)..(372): n is a, c, g, or t
gctggtacggcctggaggtaagggatcctcggagcaggcagagcagccgagccagccaagctctactccaggaagtgaaaatgtgctgcctcgagagccgctgggacttgctgtgctgctcaggctggagtgcagtgtgcaaacacggcttactgcagccttcaccttccggccgaagtgatcctcccgcctcgacctccatgtagctgggaccatagatgtgtgccaccacacccagctcatttgaaatttttgttgttgttgttgaacagaagtggtgagagtaaaataaaaataaattaaataaataatatgttttggtaaaaaaaaaagaaaaaaaacagaaaaaacaaaaaaaaaaaaaaaaaaaanaacaaaaaaaaaaggg

SEQ ID NO: 420089 - DNA, 1930 bp, Homo sapiens
acctgagtctgggcgggagggcgagagcgagggcgcctgggagaaacctcgcccagcggcggttgattagtcaggcctcagaaagatggcgtcctcggagcaggcagagcagccgagccagccaagctctactccaggaagtgaaaatgtgctgcctcgagagccgctgattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacagtgactcagttacagacgaccctcgcctccgtccaggagctgctgattcagcagcagcagaagatccaggagcttgcccacgagctggccgctgccaaggccaccacatccaccaactggatcctggagtcccagaatatcaacgaactcaagtccgaaattaactccttgaaagggcttcttttaaatcggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggcccccaggaggaaggcgagggggtggtggacgtcaagggccaggtgcggatggaggtgcaaggcgaggaggagaagagggaggacaaggaggacgaggaggatgaggaggatgatgatgtgagccatgtggacgaggaggactgcctgggggtgcagagggaggaccgccggggcggggatgggcagatcaacgagcaggtggagaagctgcggcggcccgagggcgccagcaacgagagtgagcgggactagggctgcgcctgctgcctccagccctgaggatggcatctagtgtgcccgtgcgtggccataccctgcctccctctctggccctgggagggcagcttggagcccaggtagggggcagagctgtcctcagctgcactgcggcctggtggcagtgtggggagtcacacttctgtccacctggcctcctctcgcctggccgccagccccagccccagccccagccccaggcccagctgcctttggctttgatctcaagtcaggctgaaggcagcgaagcctcggggcccaagcccctccccagccccctctcccggacagacgccttgcccagggtgtgtttgctgagtgtcttgactaccgtgacaccacgcatggccagagctagcatccccctccctccctgggcccggccctggacccgtcaggtgcctgtccccagccccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaa

SEQ ID NO: 420090 - DNA, 1418 bp, Homo sapiens
acctgagtctgggcgggagggcgagagcgagggcgcctgggagaaacctcgcccagcggcggttgattagtcaggcctcagaaagatggcgtcctcggagcaggcagagcagccgagccagccaagctctactccaggaagtgaaaatgtgctgcctcgagagccgctgattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacagtgactcagttacagacgaccctcgcctccgtccaggagctgctgattcagcagcagcagaagatccaggagcttgcccacgagctggccgctgccaaggccaccacatccaccaactggatcctggagtcccagaatatcaacgaactcaagtccgaaattaactccttgaaagggcttcttttaaatcggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggcccccaggaggaaggcgagggggtggtggacgtcaagggccaggtgcggatggaggtgcaaggcgaggaggagaagagggaggacaaggatggaggaggagctgcggtccctctggtgtctgccatccccctccctccctgggcccggccctggacccgtcaggtgcctgtccccagccccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaa

SEQ ID NO: 420091 - DNA, 2245 bp, Homo sapiens
aattatgtcttcaattatatggtacacagtacaggcactgaagaattgaagagaatagggagatcagagatggcttgcttatttaggcaaggcttcgaggaatcagaacagactataaaagggctgtgctgatagagaacgtgtgtgtgtgtgtgtgcgtgtgtacgtgcgcgtggggtaacgtttagacaggtggaggcaggaaagggaggccttccagaaagacagcatacagggcacaagggcggcgacatgggtgcgcatggccacacctgccggggagtatgaagaatcagctcgaatggagatcaggaggaacaggaaggatcgtcgcaggcctgaagctcggcagagggattagatttgacagactcagatacaggaagccagtgaagacagggaaacaacatcgcctttcatttagattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacagtgactcagttacagacgaccctcgcctccgtccaggagctgctgattcagcagcagcagaagatccaggagcttgcccacgagctggccgctgccaaggccaccacatccaccaactggatcctggagtcccagaatatcaacgaactcaagtccgaaattaactccttgaaagggcttcttttaaatcggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggcccccaggaggaaggcgagggggtggtggacgtcaagggccaggtgcggatggaggtgcaaggcgaggaggagaagagggaggacaaggaggacgaggaggatgaggaggatgatgatgtgagccatgtggacgaggaggactgcctgggggtgcagagggaggaccgccggggcggggatgggcagatcaacgagcaggtggagaagctgcggcggcccgagggcgccagcaacgagagtgagcgggactagggctgcgcctgctgcctccagccctgaggatggcatctagtgtgcccgtgcgtggccataccctgcctccctctctggccctgggagggcagcttggagcccaggtagggggcagagctgtcctcagctgcactgcggcctggtggcagtgtggggagtcacacttctgtccacctggcctcctctcgcctggccgccagccccagccccagccccagccccaggcccagctgcctttggctttgatctcaagtcaggctgaaggcagcgaagcctcggggcccaagcccctccccagccccctctcccggacagacgccttgcccagggtgtgtttgctgagtgtcttgactaccgtgacaccacgcatggccagagctagcgtccctactgcctcccgactcctcagtggaggaggagctgcggtccctctggtgtctgccatccccctccctccctgggcccggccctggacccgtcaggtgcctgtccccagccccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaa

SEQ ID NO: 420092 - DNA, 743 bp, Homo sapiens
acctgagtctgggcgggagggcgagagcgagggcgcctgggagaaacctcgcccagcggcggttgattagtcaggcctcagaaagatggcgtcctcggagcaggcagagcagccgagccagccaagctctactccaggaagtgaaaatgtgctgcctcgagagccgctgattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagcccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaa

SEQ ID NO: 420093 - DNA, 2614 bp, Homo sapiens
cgggtgttgtaagatctggggagaggggaagtactggctccttctaatcagcaacactgtgtgggcatacaatggaggaatccagtaatggaaactataggcctgagtaatttagaacagaatttcacaattatatacagcatataggtagggaaggacatggagtatataaggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacagaggtcagtgcccacgcgggccccggagggcggccgctggtgggcgccactgcattgcaccagccctggagggagccgggcctggctgcacaggatgtggtcagggcagacaaatcctcacttcctcagatgttttccaccaaagcattaggtctttttggagttcagagtagaatcctaaagactggacttttgagttggataaatgtgtaacaattttcagattaaacaaacaagagactagatccttttctccacggacacccaaacctccaccccccaccccttagtagtgctggggatccgaggccactgccccttcaccagtgcactcgcacgaggctacctcgagcggccctggggtttcctaaatgaaactcaagggtcaggacagagggttgctgggcagcgtggagtgtgtgggtttgatgctgacggcccgaggcccgagtgggaccggcctgctctgtaagcagcagcattgatcagcgagtgtttcctgagaacttctccgtgtctcatgcagcctttgtttctgataccgcttgaaacagtttcttaatgaaatgccatacctaggtgaaagtgccatttaaaaataccttgacatgttctaggataattggtgaggaatcacagaacatttagaactgggaagggtcttagtgatcacgtgatgcaggctcttctcttatcagtaggagagcaaattgctgagagtcagtcccagacaggcttggtgacagctgagattgagatccgggtggcccaatatccaggcccaggcctgtctcaacataccctgagattggcttgacaactttgttttctcaggtagcacttgtagtaaattcatatttatgatttgaccaaggaatgaagtgaacccagttgttcaattgccatttagagaatgattccggggccctgtactggggctttccagaagctcgtaacttcagctttgtagaaaggtagaacgtccctgaggaaactgcagaggcacattccatagggaagtgaggatggaacagaagtgtgtttgggagaaacagttgccatgaagaaagcaatagctctgcctttgccggggctgtgggtccggcaggctgacacctcatcccgcaagcattttgctggtctgagtcgtggtcgttcttccacgttaactttgatgacagcaccatgggcttggctgaagctgtgtcccttggacagcagtgggaggcctgagactgggtcaggagagagctgctgttgtctctctgaggctgccagttgttgtgtgttaccgatgccagaagccactgggtccctcctcacatggcagaagaaatggaaaggaaagaaccttctcactctccccagcctttttataagggctctaatcccacctgtgagggctctgtcctcatcacttaatcacctcctaaaggccccacttcttactactatcacattgaccattaagtttcaacatacaacttttcatggacacattcagaccatacgtagcacctgctgaagaacatcttggttccttccaagttttggcaagtatgaataaagctgctataaacatg

SEQ ID NO: 420094 - DNA, 4284 bp, Homo sapiens
aagttttgcaggggttacgtttgcagtcagtccggggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttctttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttaaaaaaaaaaaaaaaaaaaaaaaaattttgggcccttttggcccaagggtttttaaacttgggttttttttttggggcccaatttggggcttatttggccaattccccctttggggggggttttttggggccg

SEQ ID NO: 420095 - DNA, 4623 bp, Homo sapiens
  misc_feature (4335)..(4335): n is a, c, g, or t
aagttttgcaggggttacgtttgcagtcagtccggggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttctttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagcaaaaaaagaaacaacacaaaaacaagaacacaaaaacacaacatgttgttgggcccccgctgcggccccccgcggaaagatgctttatcataacaccacccatctgttttggtgggaacccgccggccccccaatttcgtaatcggtgcaaacgtggtgctcatctaggagctggtctccccaaacagaacaaccgctgggatcacaacacaaaggtgctggggaccttctccccccaaccagaaaaaaaagcggccgggcgagaaaaacacagacgcgntgttctgagaaaaaaccaccaagcggcgcgtcccagcaggccaaccaccgcgggacttctcaccaacgaggactccccacggagcgactcggcataaacaattaccccggccccggtgggtgtagacacgccggagctagcagcagccacgccagaacgacaagtgctggcccacaacaccaaacgcacagcgagcagacgcgagaccagacagaccagaacgcgcgatggagcgcgaaccaagagcgacgcacatccagacaaacgacagcagagacgaaccagccg

SEQ ID NO: 420096 - DNA, 4001 bp, Homo sapiens
aagttttgcaggggttacgtttgcagtcagtccggggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggattgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttctttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagca

SEQ ID NO: 420097 - DNA, 4344 bp, Homo sapiens
  misc_feature (4344)..(4344): n is a, c, g, or t
aagttttgcaggggttacgtttgcagtcagtccggggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaacacctggccactgtggcttggtcctctctcaactttacgaaaacatttgtctcggaacctgtgtttggcctgtgggtgtgggggctgtggggttcaaccgtacctgtgtctcaaaagtgcccctgtggtgaaatttcccattaatttatagcgcacgttatactatataaagaaaagttacaatctctgtgtctccagagcggtgaattacactgtggagccctctcaaaatctccaagagccccgagaaaaacactttttgtggggcttgtgaaacaactttttaaacaaaaaaaacattctctcttctttattcagagcgtgaaaaattttctctttttttattttttttttgtgtgggaacagccccaccgggtgttttctctcttcagagagaaacattttgtggtgggagaagaaaaggaaaatttttggtgtgtgcgataaacaacatttgtgtgtgtgtcttacaccaaagagatattttttcatctgtgggcaacaaaatgtgtggtgttttttttgtcggggcaaaagaaaaaatgttggtggtggttaaataattttatttttcttctcgtggtggataatgaaatagagacgtgtgtataattttttataaagtggtggggagaaatatacactttttaaagan

SEQ ID NO: 420098 - DNA, 5469 bp, Homo sapiens
aagttttgcaggggttacgtttgcagtcagtccggggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacagaggtcagtgcccacgcgggccccggagggcggccgctggtgggcgccactgcattgcaccagccctggagggagccgggcctggctgcacaggatgtggtcagggcagacaaatcctcacttcctcagatgttttccaccaaagcattaggtctttttggagttcagagtagaatcctaaagactggacttttgagttggataaatgtgtaacaattttcagattaaacaaacaagagactagatccttttctccacggacacccaaacctccaccccccaccccttagtagtgctggggatccgaggccactgccccttcaccagtgcactcgcacgaggctacctcgagcggccctggggtttcctaaatgaaactcaagggtcaggacagagggttgctgggcagcgtggagtgtgtgggtttgatgctgacggcccgaggcccgagtgggaccggcctgctctgtaagcagcagcattgatcagcgagtgtttcctgagaacttctccgtgtctcatgcagcctttgtttctgataccgcttgaaacagtttcttaatgaaatgccatacctaggtgaaagtgccatttaaaaataccttgacatgttctaggataattggtgaggaatcacagaacatttagaactgggaagggtcttagtgatcacgtgatgcaggctcttctcttatcagtaggagagcaaattgctgagagtcagtcccagacaggcttggtgacagctgagattgagatccgggtggcccaatatccaggcccaggcctgtctcaacataccctgagattggcttgacaactttgttttctcaggtagcacttgtagtaaattcatatttatgatttgaccaaggaatgaagtgaacccagttgttcaattgccatttagagaatgattccggggccctgtactggggctttccagaagctcgtaacttcagctttgtagaaaggtagaacgtccctgaggaaactgcagaggcacattccatagggaagtgaggatggaacagaagtgtgtttgggagaaacagttgccatgaagaaagcaatagctctgcctttgccggggctgtgggtccggcaggctgacacctcatcccgcaagcattttgctggtctgagtcgtggtcgttcttccacgttaactttgatgacagcaccatgggcttggctgaagctgtgtcccttggacagcagtgggaggcctgagactgggtcaggagagagctgctgttgtctctctgaggctgccagttgttgtgtgttaccgatgccagaagccactgggtccctggccttgcatcccaccactgtgtgtgttgttgaatttcccctttccgtctgcgggtcagtgaagtcatgggctgcttgtcctgtgctctctccccaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttctttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagca

SEQ ID NO: 420099 - DNA, 5984 bp, Homo sapiens
aagttttgcaggggttacgtttgcagtcagtccggggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacagaggtcagtgcccacgcgggccccggagggcggccgctggtgggcgccactgcattgcaccagccctggagggagccgggcctggctgcacaggatgtggtcagggcagacaaatcctcacttcctcagatgttttccaccaaagcattaggtctttttggagttcagagtagaatcctaaagactggacttttgagttggataaatgtgtaacaattttcagattaaacaaacaagagactagatccttttctccacggacacccaaacctccaccccccaccccttagtagtgctggggatccgaggccactgccccttcaccagtgcactcgcacgaggctacctcgagcggccctggggtttcctaaatgaaactcaagggtcaggacagagggttgctgggcagcgtggagtgtgtgggtttgatgctgacggcccgaggcccgagtgggaccggcctgctctgtaagcagcagcattgatcagcgagtgtttcctgagaacttctccgtgtctcatgcagcctttgtttctgataccgcttgaaacagtttcttaatgaaatgccatacctaggtgaaagtgccatttaaaaataccttgacatgttctaggataattggtgaggaatcacagaacatttagaactgggaagggtcttagtgatcacgtgatgcaggctcttctcttatcagtaggagagcaaattgctgagagtcagtcccagacaggcttggtgacagctgagattgagatccgggtggcccaatatccaggcccaggcctgtctcaacataccctgagattggcttgacaactttgttttctcaggtagcacttgtagtaaattcatatttatgatttgaccaaggaatgaagtgaacccagttgttcaattgccatttagagaatgattccggggccctgtactggggctttccagaagctcgtaacttcagctttgtagaaaggtagaacgtccctgaggaaactgcagaggcacattccatagggaagtgaggatggaacagaagtgtgtttgggagaaacagttgccatgaagaaagcaatagctctgcctttgccggggctgtgggtccggcaggctgacacctcatcccgcaagcattttgctggtctgagtcgtggtcgttcttccacgttaactttgatgacagcaccatgggcttggctgaagctgtgtcccttggacagcagtgggaggcctgagactgggtcaggagagagctgctgttgtctctctgaggctgccagttgttgtgtgttaccgatgccagaagccactgggtccctggccttgcatcccaccactgtgtgtgttgttgaatttcccctttccgtctgcgggtcagtgaagtcatgggctgcttgtcctgtgctctctccccaggagaaaagccttacagatgctcatgggaagggtgtgagtggcgttttgcaagaagtgatgagttaaccaggcacttccgaaagcacaccggggccaagccttttaaatgctcccactgtgacaggtacgtgcctgaggacaatgctgggcaaggagcgtggggccttgggaatgtgatgaccagggttgagtaggtgtgcagggcacattcgaaggaaggcatgcagtttcctatgtgtgaacatttcttttcaagcctgggactttttagaaagtttctggtgtgctcattgtccatggttaggaagaactgttccacatacacctgacattggagtcagtttattgatatgtttggagattggcctttcaacagttttcatatttgaagaattagaaatgaagtccgttcagattctccaaagaacctccagccactggtgggggacattcttaattcacattcctatcagttggtatctcctgtccctgaagacactgatgaggcttgggaggagaatcccacctttccctgcagggggttaggctgggcagggcagggaggtgagggcgctggtccagaacactggcaagggatgggaacctaaattcttctgtgcttctgatttgcccttgcaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttctttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagca

SEQ ID NO: 420100 - DNA, 5259 bp, Homo sapiens
cgggtgttgtaagatctggggagaggggaagtactggctccttctaatcagcaacactgtgtgggcatacaatggaggaatccagtaatggaaactataggcctgagtaatttagaacagaatttcacaattatatacagcatataggtagggaaggacatggagtatataaggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagtggctagaaagtttgaaatggtggggagaggggatgctgatctcggcagttgtagcttcttgaaaggttggttgcggggctggggaaggggtactgtccatgccacactgcatgtccatttgagctgggtccttatttggctgctgatgagaatttcaaaaggaagtctcctttggcattgcgtgaaagaaatcagagtgatgactcatgcagttgtactcttggccagtagataaagttcttgttcattgtgggactcccagcagggccgtggagtaatttccccttgcacccttcacaatagcagatggccatgctggaattatttctgcactcctgttgttgaagttccttgtttttctctgaccactgtagaagtaattaaagttctgtgtcatgcaagggcctgcacttgggaacggcattctgtgaaaacataggcggtctgggctacacaggaaatgggtggtttttctgcagctccattcgatgcccctgaatacagacagctgctgtctcctctcccccgagtgtggccctgtgttgtcagccgtgtccccaagggggtccctcagaacacgctgtgtgccgtgcagtctttctgtcctgtgtgggtatctgtggagtgtgaagggtggatggctggggctttccttaaaacacatggttcttgacaatgtcagataatctggttgaacctgttggggaggagtatgtgtatggggccggttctcttcctctggtttcatgagaaacatcaacactggtaactacaacaaaaaaaccggcttagtgatcatcactcattgtggcccttggcccaacattgggaaagccaggagaggtttcaccctccgattttcctctgaattcttaccattctagaaacagatttcctctaacttccgtaaggacacggatgcttaattacaaaaggttttgcccctgtagtgaccgggcagcaatgttatctgtccttcattcttgcatgtttttggaaattgcttttgcttttacttttggtcgtcatggcaatcacgtgccttctctggttcattttgcacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttctttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagca

SEQ ID NO: 420101 - DNA, 4259 bp, Homo sapiens
cgggtgttgtaagatctggggagaggggaagtactggctccttctaatcagcaacactgtgtgggcatacaatggaggaatccagtaatggaaactataggcctgagtaatttagaacagaatttcacaattatatacagcatataggtagggaaggacatggagtatataaggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagtggctagaaagtttgaaatggtggggagaggggatgctgatctcggcagttgtagcttcttgaaagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttctttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagca

SEQ ID NO: 420102 - DNA, 3852 bp, Homo sapiens
aagttttgcaggggttacgtttgcagtcagtccggggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccgggggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttctttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagca

SEQ ID NO: 420103 - DNA, 2825 bp, Homo sapiens
aagttttgcaggggttacgtttgcagtcagtccggggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttctttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagca

SEQ ID NO: 420104 - DNA, 2538 bp, Homo sapiens
gggaacttctttcactactaaacaaaaaaaagtctacacgacaagtgaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttctttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagca

SEQ ID NO: 420105 - DNA, 2479 bp, Homo sapiens
agggggtgtctgactaatcaaaaacaaaaaaacgaaggaacatctgggtgacgaccaagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttctttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagca

SEQ ID NO: 420106 - DNA, 2413 bp, Homo sapiens
aagttttgcaggggttacgtttgcagtcagtccggggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacagaggtcagtgcccacgcgggccccggagggcggccgctggtgggcgccactgcattgcaccagccctggagggagccgggcctggctgcacaggatgtggtcagggcagacaaatcctcacttcctcagatgttttccaccaaagcattaggtctttttggagttcagagtagaatcctaaagactggacttttgagttggataaatgtgtaacaattttcagattaaacaaacaagagactagatccttttctccacggacacccaaacctccaccccccaccccttagtagtgctggggatccgaggccactgccccttcaccagtgcactcgcacgaggctacctcgagcggccctggggtttcctaaatgaaactcaagggtcaggacagagggttgctgggcagcgtggagtgtgtgggtttgatgctgacggcccgaggcccgagtgggaccggcctgctctgtaagcagcagcattgatcagcgagtgtttcctgagaacttctccgtgtctcatgcagcctttgtttctgataccgcttgaaacagtttcttaatgaaatgccatacctaggtgaaagtgccatttaaaaataccttgacatgttctaggataattggtgaggaatcacagaacatttagaactgggaagggtcttagtgatcacgtgatgcaggctcttctcttatcagtaggagagcaaattgctgagagtcagtcccagacaggcttggtgacagctgagattgagatccgggtggcccaatatccaggcccaggcctgtctcaacataccctgagattggcttgacaactttgttttctcaggtagcacttgtagtaaattcatatttatgatttgaccaaggaatgaagtgaacccagttgttcaattgccatttagagaatgattccggggccctgtactggggctttccagaagctcgtaacttcagctttgtagaaaggtagaacgtccctgaggaaactgcagaggcacattccatagggaagtgaggatggaacagaagtgtgtttgggagaaacagttgccatgaagaaagcaatagctctgcctttgccggggctgtgggtccggcaggctgacacctcatcccgcaagcattttgctggtctgagtcgtggtcgttcttccacgttaactttgatgacagcaccatgggcttggctgaagctgtgtcccttggacagcagtgggaggcctgagactgggtcaggagagagctgctgttgtctctctgaggctgccagttgttgtgtgttaccgatgccagaagccactgggtccctggccttgcatcccaccactgtgtgtgttgtcagactgtgcaagagtgtgtctcttttttttttttggaaaggaattttggctcttgtggcgattgagggctggagtgcaatgggcttgatctcgggtcacagaaacctttgcctcccaggttcaggcgattctcttgcctcagcctccaaagtagctgcggataacgggcac

SEQ ID NO: 420107 - DNA, 726 bp, Homo sapiens
ttgatactgtatctgtttttctgtaaagttagagcttttggggaagcgaagtattgaactgggggttggtctggcctactgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttctttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagca

SEQ ID NO: 420108 - DNA, 1036 bp, Homo sapiens
cgggtgttgtaagatctggggagaggggaagtactggctccttctaatcagcaacactgtgtgggcatacaatggaggaatccagtaatggaaactataggcctgagtaatttagaacagaatttcacaattatatacagcatataggtagggaaggacatggagtatataaggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacaggtaaacgcagccggccgcggttccctgcgggcgccggggcgcgggccgggtcggctgtttggggttcagacccggtgctctctgcggtccgctgggcctgggccccgcgctgtcaccgggggagcgggcgcagcgcccccgccgatcgatcctccaggctgcgatcagcgtccgcccagggaagccccaactcccggcacagcccggccgagcccctggcacgagttcggagcctgtccccgctccagacgccacagctggagcttgtcatggggaccaacttgctctgcctgccaaggtctatcaaaggtaagaaggtaaaagaagatctaattaaacggattcggtcaagtagggtaacttggtgcttgtacttaacagttttttaaaaaaatcacattttgcccccagaacgtagaccagctctcttttatttttgtcttttttaaactgtagaccatttccaatgtgttttctgctctttggaatgcctaacatttcccctagatctgccttatttgtcttccctgcttctcttgttgaccaagaaaaataaaaataaaactgtgtacacccca

SEQ ID NO: 420109 - DNA, 4056 bp, Homo sapiens
aagttttgcaggggttacgtttgcagtcagtccggggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttctttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagca

SEQ ID NO: 420110 - DNA, 4002 bp, Homo sapiens
aagttttgcaggggttacgtttgcagtcagtccggggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacatgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttctttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagca

SEQ ID NO: 420111 - DNA, 3720 bp, Homo sapiens
aagttttgcaggggttacgtttgcagtcagtccggggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaagactttcttgcttgaatctgttccgggctgtctgctctgtccatcaaatgggcaggtctggaatggggcaccttcggccgttcagaagtggcctgaacagaatgctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttctttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagca

SEQ ID NO: 420112 - DNA, 2652 bp, Homo sapiens
aagttttgcaggggttacgtttgcagtcagtccggggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagacctacaccaccactgcatgacaccccacggggtaccagctcgattcgtatatta

SEQ ID NO: 420113 - DNA, 2313 bp, Homo sapiens
aagttttgcaggggttacgtttgcagtcagtccggggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgagctccagcggatcctgagctccagcggggatactctagagagaccaca

SEQ ID NO: 420114 - DNA, 4493 bp, Homo sapiens
cgggtgttgtaagatctggggagaggggaagtactggctccttctaatcagcaacactgtgtgggcatacaatggaggaatccagtaatggaaactataggcctgagtaatttagaacagaatttcacaattatatacagcatataggtagggaaggacatggagtatataaggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacaggtaaacgcagccggccgcggttccctgcgggcgccggggcgcgggccgggtcggctgtttggggttcagacccggtgctctctgcggtccgctgggcctgggccccgcgctgtcaccgggggagcgggcgcagcgcccccgccgatcgatcctccaggctgcgatcagcgtccgcccagggaagccccaactcccggcacagcccggccgagcccctggcacgagttcggagcctgtccccgctccagacgccacagctggagcttgtcatggggaccaacttgctctgcctgccaaggtacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttctttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagca

SEQ ID NO: 420115 - DNA, 3617 bp, Homo sapiens
aagttttgcaggggttacgtttgcagtcagtccggggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacagatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttctttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagca

SEQ ID NO: 420116 - DNA, 1678 bp, Homo sapiens
aagttttgcaggggttacgtttgcagtcagtccggggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatgcctgtcctgggagctggagaggatgtcagcgagcctgacattgccctccctgaatgcatcaaatactcttctccaaggactgacaaaaacaaccccccggctgtgggcacagtagggaaccatgccggtttgatcttccattgctcaagccagggaatgcattgcagaggcacctgcacaacgacaaacttgagtgtttccctgccacttctgtgcctccacagcctgctccagttccgcagctagagctgggcctaccttccccagccagccctgccacacacctggctgaggcatgtctgggaggggtggaggaggcagagggactccaggccagagggctgttctcacaacctcagcccactctcagtcaaggagggcagaaaataaaagatgacatcactgccaaaaaagt

SEQ ID NO: 420117 - DNA, 709 bp, Homo sapiens
  misc_feature (50)..(50): n is a, c, g, or t
taagaatatagaattttatcttcctttattaaaaaaaataatcgtaccangggaggaagaattggcaccttcctagggaaggagacgagcgcttcgccttgattctccgagaagcctccgagaagtgctttaagtgtgtttgcatgcgccaggcggtgggcagcgggggcctgtccagccctctcccgccatccttccccaagtgacgtccactgccttgtcaccagcgacctgcctgtcatgcccaccccctgaggaagcatggggaccctaacaccctggtgccctgcaccagacaggccgtggtcaggcccaggccaccggccgggttctgccacagcttcccacgtgcttgctgacatgcgtgtgcctgtgtgtggtgtctgttgctgtgtcgtgaaactgtgaccatcactcagtccaaacaagtgagtggccctcgaggccacagttatgcaactttcagtgtgtgtcataacgacgtcactgctttttaaactcgataactctttattttagtaaaatgcccaggagtcctggaagctacgcggacttgcagaggttttattttttggccttagaatctgcagaaattaggaggcaccgagcccagcgcagcagcctcggacccggattgcgtttgccttagcggatatgtttatacagatgaatataaaatgtttttttctttgggctttttgcttctttt

SEQ ID NO: 420118 - DNA, 2305 bp, Homo sapiens
agtgtcaggaagaggaagagcgcggccggcggcgctgcgctgagagcaggggcccggccaaggcgagtgccgcgcgggccaccatggccacggacgagctggccaccaagctgagccggcggctgcagatggagggcgagggcggcggcgagaccccggagcagcccgggctgaacggggcagcggcggcggcggcgggggcacccgacgaggcggccgaggcgctgggcagcgcggactgcgagctgagcgccaagctgctgcggcgcgcagacctcaaccagggcatcggcgagccccagtcgcccagccgccgcgtcttcaacccctacaccgagttcaaggagttctccaggaagcagatcaaggacatggagaagatgttcaagcagtatgatgccgggcgggacggcttcatcgacctgatggagctaaaactcatgatggagaaacttggggcccctcagacccacctgggcctgaaaaacatgatcaaggaggtggatgaggactttgacagcaagctgagcttccgggagttcctcctgatcttccgcaaggcggcggccggggagcttcaggaggacagcgggctgtgcgtgctggcccgcctctctgagatcgacgtctccagtgagggtgtcaagggggccaagagcttctttgaggccaaggtccaggccatcaacgtgtccagccgcttcgaggaggagatcaaggcagagcaggaggaaaggaagaagcaggcggaggagatgaagcagcggaaagcggccttcaaggagctgcagtccacctttaagtagcgggggctgcagccgaccgccctgctccggccccagtgtggtgggcgagggtggcgcatgggaggccgagcctgaatccttgcctgtgtctgacgggaccactactaaaaacctaaaaatatctgtgaatggagcaagttcaggggtcttatggaggtggcccggcccctccccgctcccttccactctgcacgaggccgccacaccggcgctggctccctgcccggcccggccctccctggcaatccctgggctctcttgcacccctaactgccccctgcctgctccggcactgccccaggcccagctcctggccctaggtccctcccagccccatgtgcctgccgcctgccctccacacatccctgtccccccaacccgggaacccctgccctcctccagcaggccgcaccgcccctggggccccctgccagccccttcccaggctgggagacggcagaagagatagaatcagggctgcccccacagagtgggacccaaggggctaattggaggcacgaggggacccctccccagggccttttcctcctctgcgtcttccatctactgaaatgggagagggggtggggagcttctgttctggtgaagggacccgggcaggcccccagcaccccatgctgacttggagaaccccagatctctggggcccagccaggcagggtgtgggggcagctgtgccaatctacctcacaggcccaccccctgccgggcatgccgtgggatcatgggcagggaaggctctgggggtcggagacaccgctgcttagcacccccagccagaacaccctgagggtctcggggctctggagagagtggggcgggaggaagaattggcaccttcctagggaaggagacgagcgcttcgccttgattctccgagaagcctccgagaagtgctttaagtgtgtttgcatgcgccaggcggtgggcagcgggggcctgtccagccctctcccgccatccttccccaagtgacgtccactgccttgtcaccagcgacctgcctgtcatgcccaccccctgaggaagcatggggaccctaacaccctggtgccctgcaccagacaggccgtggtcaggcccaggccaccggccgggttctgccacagcttcccacgtgcttgctgacatgcgtgtgcctgtgtgtggtgtctgttgctgtgtcgtgaaactgtgaccatcactcagtccaaacaagtgagtggccctcgaggccacagttatgcaactttcagtgtgtgtcataacgacgtcactgctttttaaactcgataactctttattttagtaaaatgcccaggagtcctggaagctacgcggacttgcagaggttttattttttggccttagaatctgcagaaattaggaggcaccgagcccagcgcagcagcctcggacccggattgcgtttgccttagcggatatgtttatacagatgaatataaaatgtttttttctttgggctttttgcttctttt

SEQ ID NO: 420119 - DNA, 2751 bp, Homo sapiens
agtgtcaggaagaggaagagcgcggccggcggcgctgcgctgagagcaggggcccggccaaggcgagtgccgcgcgggccaccatggccacggacgagctggccaccaagctgagccggcggctgcagatggagggcgagggcggcggcgagaccccggagcagcccgggctgaacggggcagcggcggcggcggcgggggcacccgacgaggcggccgaggcgctgggcagcgcggactgcgagctgagcgccaagctgctgcggcgcgcagacctcaaccagggcatcggcgagccccagtcgcccagccgccgcgtcttcaacccctacaccgagttcaaggagttctccaggaagcagatcaaggacatggagaagatgttcaagcagtatgatgccgggcgggacggcttcatcgacctgatggagctaaaactcatgatggagaaacttggggcccctcagacccacctgggcctgaaaaacatgatcaaggaggtggatgaggactttgacagcaagctgagcttccgggagttcctcctgatcttccgcaaggcggcggccggggagcttcaggaggacagcgggctgtgcgtgctggcccgcctctctgagatcgacgtctccagtgagggtgtcaagggggccaagagcttctttgaggccaaggtccaggccatcaacgtgtccagccgcttcgaggaggagatcaaggcagagcaggaggaaaggaagaagcaggcggaggagatgaagcagcggaaagcggccttcaaggagctgcagtccacctttaagtagcgggggctgcagccgaccgccctgctccggccccagtgtggtgggcgagggtggcgcatgggaggccgagcctgaatccttgcctgtgtctgacgggaccactactaaaaacctaaaaatatctgtgaatggagcaagttcaggggtcttatggaggtggcccggcccctccccgctcccttccactctgcacgaggccgccacaccggcgctggctccctgcccggcccggccctccctggcaatccctgggctctcttgcacccctaactgccccctgcctgctccggcactgccccaggcccagctcctggccctaggtccctcccagccccatgtgcctgccgcctgccctccacacatccctgtccccccaacccgggaacccctgccctcctccagcaggccgcaccgcccctggggccccctgccagccccttcccaggctgggagacggcagaagagatagaatcagggctgcccccacagagtgggacccaaggggctaattggaggcacgaggggacccctccccagggccttttcctcctctgcgtcttccatctactgaaatgggagagggggtggggagcttctgttctggtgaagggacccgggcaggcccccagcaccccatgctgacttggagaaccccagatctctggggcccagccaggcagggtgtgggggcagctgtgccaatctacctcacaggcccaccccctgccgggcatgccgtgggatcatgggcagggaaggctctgggggtcggagacaccgctgcttagcacccccagccagaacaccctgagggtctcggggctctggagagagtggggcgggaggaagaattggcaccttcctagggaaggagacgagcgcttcgccttgattctccgagaagcctccgagaagtgctttaagtgtgtttgcatgcgccaggcggtgggcagcgggggcctgtccagccctctcccgccatccttccccaagtgacgtccactgccttgtcaccagcgacctgcctgtcatgcccaccccctgaggaagcatggggaccctaacaccctggtgccctgcaccagacaggccgtggtcaggcccaggccaccggccgggttctgccacagcttcccacgtgcttgctgacatgcgtgtgcctgtgtgtggtgtctgttgctgtgtcgtgaaactgtgaccatcactcagtccaaacaagtgagtggccctcgaggccacagttatgcaactttcagtgtgtgtcataacgacgtcactgctttttaaactcgataactctttattttagtaaaatgcccaggagtcctggaagctacgcggacttgcagaggttttattttttggccttagaatctgcagaaattaggaggcaccgagcccagcgcagcagcctcggacccggattgcgtttgccttagcggatatgtttatacagatgaatataaaatgtttttttctttgggctttttgcttcttttttcccccccttctcaccttcccttctccccgaccccaccccccaaaaaagctacttcttcattccgtggtacgattattttttttaactaaaggaagataaaaaaaaaaaaaaaaaaaaaaaaaattgtgtgtggcgcgcgcctcggcgccccgcggaaaagagttttaaaaaacccatctggggtggtgggcgagcgcggggcccccagtgaggattaggtggcacacgtgggccaagggcgtggtttcccagaggaaaaactcgcgggccagagaacagagggcgtgggtttccccacaagttaaaaaaaaccgccgcggggggaaaccgggaaggcttttgtggaacaaactccaaacagggaagtgcgcagaggccaacgcggcgctcttccacacgagaagctccagagggaactcggaataaaaatacgcccgcccgggt

SEQ ID NO: 420120 - DNA, 1918 bp, Homo sapiens
tcgtctatgtcgtgctggtgttaatcggccgaggctgagcttccgggagttcctcctgatcttccgcaaggcggcggccggggagcttcaggaggacagcgggctgtgcgtgctggcccgcctctctgagatcgacgtctccagtgagggtgtcaagggggccaagagcttctttgaggccaaggtccaggccatcaacgtgtccagccgcttcgaggaggagatcaaggcagagcaggaggaaaggaagaagcaggcggaggagatgaagcagcggaaagcggccttcaaggagctgcagtccacctttaagtagcgggggctgcagccgaccgccctgctccggccccagtgtggtgggcgagggtggcgcatgggaggccgagcctgaatccttgcctgtgtctgacgggaccactactaaaaacctaaaaatatctgtgaatggagcaagttcaggggtcttatggaggtggcccggcccctccccgctcccttccactctgcacgaggccgccacaccggcgctggctccctgcccggcccggccctccctggcaatccctgggctctcttgcacccctaactgccccctgcctgctccggcactgccccaggcccagctcctggccctaggtccctcccagccccatgtgcctgccgcctgccctccacacatccctgtccccccaacccgggaacccctgccctcctccagcaggccgcaccgcccctggggccccctgccagccccttcccaggctgggagacggcagaagagatagaatcagggctgcccccacagagtgggacccaaggggctaattggaggcacgaggggacccctccccagggccttttcctcctctgcgtcttccatctactgaaatgggagagggggtggggagcttctgttctggtgaagggacccgggcaggcccccagcaccccatgctgacttggagaaccccagatctctggggcccagccaggcagggtgtgggggcagctgtgccaatctacctcacaggcccaccccctgccgggcatgccgtgggatcatgggcagggaaggctctgggggtcggagacaccgctgcttagcacccccagccagaacaccctgagggtctcggggctctggagagagtggggcgggaggaagaattggcaccttcctagggaaggagacgagcgcttcgccttgattctccgagaagcctccgagaagtgctttaagtgtgtttgcatgcgccaggcggtgggcagcgggggcctgtccagccctctcccgccatccttccccaagtgacgtccactgccttgtcaccagcgacctgcctgtcatgcccaccccctgaggaagcatggggaccctaacaccctggtgccctgcaccagacaggccgtggtcaggcccaggccaccggccgggttctgccacagcttcccacgtgcttgctgacatgcgtgtgcctgtgtgtggtgtctgttgctgtgtcgtgaaactgtgaccatcactcagtccaaacaagtgagtggccctcgaggccacagttatgcaactttcagtgtgtgtcataacgacgtcactgctttttaaactcgataactctttattttagtaaaatgcccaggagtcctggaagctacgcggacttgcagaggttttattttttggccttagaatctgcagaaattaggaggcaccgagcccagcgcagcagcctcggacccggattgcgtttgccttagcggatatgtttatacagatgaatataaaatgtttttttctttgggctttttgcttcttttttcccccccttctcaccttcccttctccccgaccccaccccccaaaaaagctacttcttcattccgtggtacgattattttttttaactaaaggaagataaaa

SEQ ID NO: 420121 - DNA, 2519 bp, Homo sapiens
agtgtcaggaagaggaagagcgcggccggcggcgctgcgctgagagcaggggcccggccaaggcgagtgccgcgcgggccaccatggccacggacgagctggccaccaagctgagccggcggctgcagatggagggcgagggcggcggcgagaccccggagcagcccgggctgaacggggcagcggcggcggcggcgggggcacccgacgaggcggccgaggcgctgggcagcgcggactgcgagctgagcgccaagctgctgcggcgcgcagacctcaaccagggcatcggcgagccccagtcgcccagccgccgcgtcttcaacccctacaccgagttcaaggagttctccaggaagcagatcaaggacatggagaagatgttcaagcagtatgatgccgggcgggacggcttcatcgacctgatggagctaaaactcatgatggagaaacttggggcccctcagacccacctgggcctgaaaaacatgatcaaggaggtggatgaggactttgacagcaagctgagcttccgggagttcctcctgatcttccgcaaggcggcggccggggagcttcaggaggacagcgggctgtgcgtgctggcccgcctctctgagatcgacgtctccagtgagggtgtcaagggggccaagagcttctttgaggccaagtggaactgggtgtgccgctggggtcccggacaggaagcagaggatcaggatggcagcagcttgagcgactcccttcgagcgcccttgctctgcagcagccacagaatataggtccaggccatcaacgtgtccagccgcttcgaggaggagatcaaggcagagcaggaggaaaggaagaagcaggcggaggagatgaagcagcggaaagcggccttcaaggagctgcagtccacctttaagtagcgggggctgcagccgaccgccctgctccggccccagtgtggtgggcgagggtggcgcatgggaggccgagcctgaatccttgcctgtgtctgacgggaccactactaaaaacctaaaaatatctgtgaatggagcaagttcaggggtcttatggaggtggcccggcccctccccgctcccttccactctgcacgaggccgccacaccggcgctggctccctgcccggcccggccctccctggcaatccctgggctctcttgcacccctaactgccccctgcctgctccggcactgccccaggcccagctcctggccctaggtccctcccagccccatgtgcctgccgcctgccctccacacatccctgtccccccaacccgggaacccctgccctcctccagcaggccgcaccgcccctggggccccctgccagccccttcccaggctgggagacggcagaagagatagaatcagggctgcccccacagagtgggacccaaggggctaattggaggcacgaggggacccctccccagggccttttcctcctctgcgtcttccatctactgaaatgggagagggggtggggagcttctgttctggtgaagggacccgggcaggcccccagcaccccatgctgacttggagaaccccagatctctggggcccagccaggcagggtgtgggggcagctgtgccaatctacctcacaggcccaccccctgccgggcatgccgtgggatcatgggcagggaaggctctgggggtcggagacaccgctgcttagcacccccagccagaacaccctgagggtctcggggctctggagagagtggggcgggaggaagaattggcaccttcctagggaaggagacgagcgcttcgccttgattctccgagaagcctccgagaagtgctttaagtgtgtttgcatgcgccaggcggtgggcagcgggggcctgtccagccctctcccgccatccttccccaagtgacgtccactgccttgtcaccagcgacctgcctgtcatgcccaccccctgaggaagcatggggaccctaacaccctggtgccctgcaccagacaggccgtggtcaggcccaggccaccggccgggttctgccacagcttcccacgtgcttgctgacatgcgtgtgcctgtgtgtggtgtctgttgctgtgtcgtgaaactgtgaccatcactcagtccaaacaagtgagtggccctcgaggccacagttatgcaactttcagtgtgtgtcataacgacgtcactgctttttaaactcgataactctttattttagtaaaatgcccaggagtcctggaagctacgcggacttgcagaggttttattttttggccttagaatctgcagaaattaggaggcaccgagcccagcgcagcagcctcggacccggattgcgtttgccttagcggatatgtttatacagatgaatataaaatgtttttttctttgggctttttgcttcttttttcccccccttctcaccttcccttctccccgaccccaccccccaaaaaagctacttcttcattccgtggtacgattattttttttaactaaaggaagataaaa

SEQ ID NO: 420122 - DNA, 1437 bp, Homo sapiens
  misc_feature (112)..(112): n is a, c, g, or t
  misc_feature (123)..(124): n is a, c, g, or t
  misc_feature (133)..(133): n is a, c, g, or t
  misc_feature (136)..(136): n is a, c, g, or t
  misc_feature (180)..(180): n is a, c, g, or t
  misc_feature (182)..(182): n is a, c, g, or t
  misc_feature (192)..(193): n is a, c, g, or t
cttcttctttttttctggtcatattcattgatggccgtggtatctctggacatggtcctgccggtgcgtcttatcgcatatgatgcaggggccctgtccaattgctgatgtncctgctgctgnntgccaccantgnccactggactgagctggccaccaatgctgatgcctggctggctncnagattgatgnngctgatggtgctgtgctgtgccgggaacccctgccctcctccagcaggccgcaccgcccctggggccccctgccagccccttcccaggctgggagacggcagaagagatagaatcagggctgcccccacagagtgggacccaaggggctaattggaggcacgaggggacccctccccagggccttttcctcctctgcgtcttccatctactgaaatgggagagggggtggggagcttctgttctggtgaagggacccgggcaggcccccagcaccccatgctgacttggagaaccccagatctctggggcccagccaggcagggtgtgggggcagctgtgccaatctacctcacaggcccaccccctgccgggcatgccgtgggatcatgggcagggaaggctctgggggtcggagacaccgctgcttagcacccccagccagaacaccctgagggtctcggggctctggagagagtggggcgggaggaagaattggcaccttcctagggaaggagacgagcgcttcgccttgattctccgagaagcctccgagaagtgctttaagtgtgtttgcatgcgccaggcggtgggcagcgggggcctgtccagccctctcccgccatccttccccaagtgacgtccactgccttgtcaccagcgacctgcctgtcatgcccaccccctgaggaagcatggggaccctaacaccctggtgccctgcaccagacaggccgtggtcaggcccaggccaccggccgggttctgccacagcttcccacgtgcttgctgacatgcgtgtgcctgtgtgtggtgtctgttgctgtgtcgtgaaactgtgaccatcactcagtccaaacaagtgagtggccctcgaggccacagttatgcaactttcagtgtgtgtcataacgacgtcactgctttttaaactcgataactctttattttagtaaaatgcccaggagtcctggaagctacgcggacttgcagaggttttattttttggccttagaatctgcagaaattaggaggcaccgagcccagcgcagcagcctcggacccggattgcgtttgccttagcggatatgtttatacagatgaatataaaatgtttttttctttgggctttttgcttcttttttcccccccttctcaccttcccttctccccgaccccaccccccaaaaaagctacttcttcattccgtggtacgattattttttttaactaaaggaagataaaa

SEQ ID NO: 420123 - DNA, 812 bp, Homo sapiens
  misc_feature (50)..(50): n is a, c, g, or t
taagaatatagaattttatcttcctttattaaaaaaaataatcgtaccangggaggaagaattggcaccttcctagggaaggagacgagcgcttcgccttgattctccgagaagcctccgagaagtgctttaagtgtgtttgcatgcgccaggcggtgggcagcgggggcctgtccagccctctcccgccatccttccccaagtgacgtccactgccttgtcaccagcgacctgcctgtcatgcccaccccctgaggaagcatggggaccctaacaccctggtgccctgcaccagacaggccgtggtcaggcccaggccaccggccgggttctgccacagcttcccacgtgcttgctgacatgcgtgtgcctgtgtgtggtgtctgttgctgtgtcgtgaaactgtgaccatcactcagtccaaacaagtgagtggccctcgaggccacagttatgcaactttcagtgtgtgtcataacgacgtcactgctttttaaactcgataactctttattttagtaaaatgcccaggagtcctggaagctacgcggacttgcagaggttttattttttggccttagaatctgcagaaattaggaggcaccgagcccagcgcagcagcctcggacccggattgcgtttgccttagcggatatgtttatacagatgaatataaaatgtttttttctttgggctttttgcttcttttttcccccccttctcaccttcccttctccccgaccccaccccccaaaaaagctacttcttcattccgtggtacgattattttttttaactaaaggaagataaaa

SEQ ID NO: 420124 - DNA, 1022 bp, Homo sapiens
agtgtcaggaagaggaagagcgcggccggcggcgctgcgctgagagcaggggcccggccaaggcgagtgccgcgcgggccaccatggccacggacgagctggccaccaagctgagccggcggctgcagatggagggcgagggcggcggcgagaccccggagcagcccgggctgaacggggcagcggcggcggcggcgggggcacccgacgaggcggccgaggcgctgggcagcgcggactgcgagctgagcgccaagctgctgcggcgcgcagacctcaaccagggcatcggcgagccccagtcgcccagccgccgcgtcttcaacccctacaccgagttcaaggagttctccaggaagcagatcaaggacatggagaagatgttcaagcagtatgatgccgggcgggacggcttcatcgacctgatggagctaaaactcatgatggagaaacttggggcccctcagacccacctgggcctgaaaaacatgatcaaggaggtggatgaggactttgacagcaagctgagcttccgggagttcctcctgatcttccgcaaggcggcggccggggagcttcaggaggacagcgggctgtgcgtgctggcccgcctctctgagatcgacgtctccagtgagggtgtcaagggggccaagagcttctttgaggccaagtggaactgggtgtgccgctggggtcccggacaggaagcagaggatcaggatggcagcagcttgagcgactcccttcgagcgcccttgctctgcagcagccacagaatataggttctctatttcaatcctctcaacaactccctaagatcagagttattgggtgccaggttctaagtgaggaaactgaggctcaggaaggtgaatgaagtgcctgacccagggccagagctggtgaggtcaagctgtttgtgttgctgggcaggactcagcagaagcctgagccagaagggaccccaggaaaagcagtcataaggccgggcgcagtggctcacacctgtcatcccagca

SEQ ID NO: 420125 - DNA, 124 bp, Homo sapiens
cccccccttctcaccttcccttctccccgaccccaccccccaaaaaagctacttcttcattccgtggtacgattattttttttaactaaaggaagataaaaattctatattcttatgtgtgtat

SEQ ID NO: 420126 - DNA, 2408 bp, Homo sapiens
agtgtcaggaagaggaagagcgcggccggcggcgctgcgctgagagcaggggcccggccaaggcgagtgccgcgcgggccaccatggccacggacgagctggccaccaagctgagccggcggctgcagatggagggcgagggcggcggcgagaccccggagcagcccgggctgaacggggcagcggcggcggcggcgggggcacccgacgaggcggccgaggcgctgggcagcgcggactgcgagctgagcgccaagctgctgcggcgcgcagacctcaaccagggcatcggcgagccccagtcgcccagccgccgcgtcttcaacccctacaccgagttcaaggagttctccaggaagcagatcaaggacatggagaagatgttcaagcagtatgatgccgggcgggacggcttcatcgacctgatggagctaaaactcatgatggagaaacttggggcccctcagacccacctgggcctgaaaaacatgatcaaggaggtggatgaggactttgacagcaagctgagcttccgggagttcctcctgatcttccgcaaggcggcggccggggagcttcaggaggacagcgggctgtgcgtgctggcccgcctctctgagatcgacgtctccagtgagggtgtcaagggggccaagagcttctttgaggccaaggtccaggccatcaacgtgtccagccgcttcgaggaggagatcaaggcagagcaggaggaaaggaagaagcaggcggaggagatgaagcagcggaaagcggccttcaaggagctgcagtccacctttaagtagcgggggctgcagccgaccgccctgctccggccccagtgtggtgggcgagggtggcgcatgggaggccgagcctgaatccttgcctgtgtctgacgggaccactactaaaaacctaaaaatatctgtgaatggagcaagttcaggggtcttatggaggtggcccggcccctccccgctcccttccactctgcacgaggccgccacaccggcgctggctccctgcccggcccggccctccctggcaatccctgggctctcttgcacccctaactgccccctgcctgctccggcactgccccaggcccagctcctggccctaggtccctcccagccccatgtgcctgccgcctgccctccacacatccctgtccccccaacccgggaacccctgccctcctccagcaggccgcaccgcccctggggccccctgccagccccttcccaggctgggagacggcagaagagatagaatcagggctgcccccacagagtgggacccaaggggctaattggaggcacgaggggacccctccccagggccttttcctcctctgcgtcttccatctactgaaatgggagagggggtggggagcttctgttctggtgaagggacccgggcaggcccccagcaccccatgctgacttggagaaccccagatctctggggcccagccaggcagggtgtgggggcagctgtgccaatctacctcacaggcccaccccctgccgggcatgccgtgggatcatgggcagggaaggctctgggggtcggagacaccgctgcttagcacccccagccagaacaccctgagggtctcggggctctggagagagtggggcgggaggaagaattggcaccttcctagggaaggagacgagcgcttcgccttgattctccgagaagcctccgagaagtgctttaagtgtgtttgcatgcgccaggcggtgggcagcgggggcctgtccagccctctcccgccatccttccccaagtgacgtccactgccttgtcaccagcgacctgcctgtcatgcccaccccctgaggaagcatggggaccctaacaccctggtgccctgcaccagacaggccgtggtcaggcccaggccaccggccgggttctgccacagcttcccacgtgcttgctgacatgcgtgtgcctgtgtgtggtgtctgttgctgtgtcgtgaaactgtgaccatcactcagtccaaacaagtgagtggccctcgaggccacagttatgcaactttcagtgtgtgtcataacgacgtcactgctttttaaactcgataactctttattttagtaaaatgcccaggagtcctggaagctacgcggacttgcagaggttttattttttggccttagaatctgcagaaattaggaggcaccgagcccagcgcagcagcctcggacccggattgcgtttgccttagcggatatgtttatacagatgaatataaaatgtttttttctttgggctttttgcttcttttttcccccccttctcaccttcccttctccccgaccccaccccccaaaaaagctacttcttcattccgtggtacgattattttttttaactaaaggaagataaaa

SEQ ID NO: 420127 - DNA, 2490 bp, Homo sapiens
  misc_feature (112)..(112): n is a, c, g, or t
  misc_feature (123)..(124): n is a, c, g, or t
  misc_feature (133)..(133): n is a, c, g, or t
  misc_feature (136)..(136): n is a, c, g, or t
  misc_feature (180)..(180): n is a, c, g, or t
  misc_feature (182)..(182): n is a, c, g, or t
  misc_feature (192)..(193): n is a, c, g, or t
cttcttctttttttctggtcatattcattgatggccgtggtatctctggacatggtcctgccggtgcgtcttatcgcatatgatgcaggggccctgtccaattgctgatgtncctgctgctgnntgccaccantgnccactggactgagctggccaccaatgctgatgcctggctggctncnagattgatgnngctgatggtgctgtgctgtgctgatgacccctgtgatgcaagccctggtgcttgaactgtgggcatgctgtgcgtgcgtgctggcgggggcacccgacgaggcggccgaggcgctgggcagcgcggactgcgagctgagcgccaagctgctgcggcgcgcagacctcaaccagggcatcggcgagccccagtcgcccagccgccgcgtcttcaacccctacaccgagttcaaggagttctccaggaagcagatcaaggacatggagaagatgttcaagcagtatgatgccgggcgggacggcttcatcgacctgatggagctaaaactcatgatggagaaacttggggcccctcagacccacctgggcctgaaaaacatgatcaaggaggtggatgaggactttgacagcaagctgagcttccgggagttcctcctgatcttccgcaaggcggcggccggggagcttcaggaggacagcgggctgtgcgtgctggcccgcctctctgagatcgacgtctccagtgagggtgtcaagggggccaagagcttctttgaggccaaggtccaggccatcaacgtgtccagccgcttcgaggaggagatcaaggcagagcaggaggaaaggaagaagcaggcggaggagatgaagcagcggaaagcggccttcaaggagctgcagtccacctttaagtagcgggggctgcagccgaccgccctgctccggccccagtgtggtgggcgagggtggcgcatgggaggccgagcctgaatccttgcctgtgtctgacgggaccactactaaaaacctaaaaatatctgtgaatggagcaagttcaggggtcttatggaggtggcccggcccctccccgctcccttccactctgcacgaggccgccacaccggcgctggctccctgcccggcccggccctccctggcaatccctgggctctcttgcacccctaactgccccctgcctgctccggcactgccccaggcccagctcctggccctaggtccctcccagccccatgtgcctgccgcctgccctccacacatccctgtccccccaacccgggaacccctgccctcctccagcaggccgcaccgcccctggggccccctgccagccccttcccaggctgggagacggcagaagagatagaatcagggctgcccccacagagtgggacccaaggggctaattggaggcacgaggggacccctccccagggccttttcctcctctgcgtcttccatctactgaaatgggagagggggtggggagcttctgttctggtgaagggacccgggcaggcccccagcaccccatgctgacttggagaaccccagatctctggggcccagccaggcagggtgtgggggcagctgtgccaatctacctcacaggcccaccccctgccgggcatgccgtgggatcatgggcagggaaggctctgggggtcggagacaccgctgcttagcacccccagccagaacaccctgagggtctcggggctctggagagagtggggcgggaggaagaattggcaccttcctagggaaggagacgagcgcttcgccttgattctccgagaagcctccgagaagtgctttaagtgtgtttgcatgcgccaggcggtgggcagcgggggcctgtccagccctctcccgccatccttccccaagtgacgtccactgccttgtcaccagcgacctgcctgtcatgcccaccccctgaggaagcatggggaccctaacaccctggtgccctgcaccagacaggccgtggtcaggcccaggccaccggccgggttctgccacagcttcccacgtgcttgctgacatgcgtgtgcctgtgtgtggtgtctgttgctgtgtcgtgaaactgtgaccatcactcagtccaaacaagtgagtggccctcgaggccacagttatgcaactttcagtgtgtgtcataacgacgtcactgctttttaaactcgataactctttattttagtaaaatgcccaggagtcctggaagctacgcggacttgcagaggttttattttttggccttagaatctgcagaaattaggaggcaccgagcccagcgcagcagcctcggacccggattgcgtttgccttagcggatatgtttatacagatgaatataaaatgtttttttctttgggctttttgcttcttttttcccccccttctcaccttcccttctccccgaccccaccccccaaaaaagctacttcttcattccgtggtacgattattttttttaactaaaggaagataaaa

SEQ ID NO: 420128 - DNA, 2347 bp, Homo sapiens
agtgtcaggaagaggaagagcgcggccggcggcgctgcgctgagagcaggggcccggccaaggcgagtgccgcgcgggccaccatggccacggacgagctggccaccaagctgagccggcggctgcagatggagggcgagggcggcggcgagaccccggagcagcccgggctgaacggggcagcggcggcggcggcgggggcacccgacgaggcggccgaggcgctgggcagcgcggactgcgagctgagcgccaagctgctgcggcgcgcagacctcaaccagggcatcggcgagccccagtcgcccagccgccgcgtcttcaacccctacaccgagttcaaggagttctccaggaagcagatcaaggacatggagaagatgttcaagcagtatgatgccgggcgggacggcttcatcgacctgatggagctaaaactcatgatggagaaacttggggcccctcagacccacctgggcctgaaaaacatgatcaaggaggtggatgaggactttgacagcaagctgagcttccgggagttcctcctgatcttccgcaaggcggcggccggggagcttcaggaggacagcgggctgtgcgtgctggcccgcctctctgagatcgacgtctccagtgagggtgtcaagggggccaagagcttctttgaggccaaggtccaggccatcaacgtgtccagccgcttcgaggaggagatcaaggcagagcaggaggaaaggaagaagcaggcggaggagatgaagcagcggaaagcggccttcaaggagctgcagtccacctttaagtagcgggggctgcagccgaccgccctgctccggccccagtgtggtgggcgagggtggcgcatgggaggccgagcctgaatccttgcctgtgtctgacgggaccactactaaaaacctaaaaatatctgtgaatggagcaagttcaggggtcttatggaggtggcccggcccctccccgctcccttccactctgcacgaggccgccacaccggcgctggctccctgcccggcccggccctccctggcaatccctgggctctcttgcacccctaactgccccctgcctgctccggcactgccccaggcccagctcctggccctaggtccctcccagccccatgtgcctgccgcctgccctccacacatccctgtccccccaacccgggaacccctgccctcctccagcaggccgcaccgcccctggggccccctgccagccccttcccaggctgggagacggcagaagagatagaatcagggctgcccccacagagtgggacccaaggggctaattggaggcacgaggggacccctccccagggccttttcctcctctgcgtcttccatctactgaaatgggagagggggtggggagcttctgttctggtgaagggacccgggcaggcccccagcaccccatgctgacttggagaaccccagatctctggggcccagccaggcagggtgtgggggcagctgtgccaatctacctcacaggcccaccccctgccgggcatgccgtgggatcatgggcagggaaggctctgggggtcggagacaccgctgcttagcacccccagccagaacaccctgagggtctcggggctctggagagagtggggcgggaggaagaattggcaccttcctagggaaggagacgagcgcttcgccttgattctccgagaagcctccgagaagtgctttaagtgtgtttgcatgcgccaggcggtgggcagcgggggcctgtccagccctctcccgccatccttccccaagtgacgtccactgccttgtcaccagcgacctgcctgtcatgcccaccccctgaggaagcatggggaccctaacaccctggtgccctgcaccagacaggccgtggtcaggcccaggccaccggccgggttctgccacagcttcccacgtgcttgctgacatgcgtgtgcctgtgtgtggtgtctgttgctgtgtcgtgaaactgtgaccatcactcagtccaaacaagtgagtggccctcgaggccacagttatgcaactttcagtgtgtgtcataacgacgtcactgctttttaaactcgataactctttattttagtaaaatgcccaggagtcctggaagctacgcggacttgcagaggttttattttttggccttagaatctgcagaaattaggaggcaccgagcccagcgcagcagcctcggacccggattgcgtttgccttagcggatatgtttatacagatgaatataaaatgtttttttctttgggctttttgcttcttttttccgtggtacgattattttttttaactaaaggaagataaaa

SEQ ID NO: 420129 - DNA, 1949 bp, Homo sapiens
agtgtcaggaagaggaagagcgcggccggcggcgctgcgctgagagcaggggcccggccaaggcgagtgccgcgcgggccaccatggccacggacgagctggccaccaagctgagccggcggctgcagatggagggcgagggcggcggcgagaccccggagcagcccgggctgaacggggcagcggcggcggcggcgggggcacccgacgaggcggccgaggcgctgggcagcgcggactgcgagctgagcgccaagctgctgcggcgcgcagacctcaaccagggcatcggcgagccccagtcgcccagccgccgcgtcttcaacccctacaccgagttcaaggagttctccaggaagcagatcaaggacatggagaagatgttcaagcagtatgatgccgggcgggacggcttcatcgacctgatggagctaaaactcatgatggagaaacttggggcccctcagacccacctgggcctgaaaaacatgatcaaggaggtggatgaggactttgacagcaagctgagcttccgggagttcctcctgatcttccgcaaggcggcggccggggagcttcaggaggacagcgggctgtgcgtgctggcccgcctctctgagatcgacgtctccagtgagggtgtcaagggggccaagagcttctttgaggccaaggtccaggccatcaacgtgtccagccgcttcgaggaggagatcaaggcagagcaggaggaaaggaagaagcaggcggaggagatgaagcagcggaaagcggccttcaaggagctgcagtccacctttaagtagcgggggctgcagccgaccgccctgctccggccccagtgtggtgggcgagggtggcgcatgggaggccgagcctgaatccttgcctgtgtctgacgggaccactactaaaaacctaaaaatatctgtgaatggagcaagttcaggggtcttatggaggtggcccggcccctccccgctcccttccactctgcacgaggccgccacaccggcgctggctccctgcccggcccggccctccctggcaatccctgggctctcttgcacccctaactgccccctgcctgctccggcactgccccaggcccagctcctggccctaggtccctcccagccccatgtgcctgccgcctgccctccacacatccctgtccccccaacccgggaacccctgccctcctccagcaggccgcaccgcccctggggccccctgccagccccttcccaggctgggagacggcagaagagatagaatcagggctgcccccacagagtgggacccaaggggctaattggaggcacgaggggacccctccccagggccttttcctcctctgcgtcttccatctactgaaatgggagagggggtggggagcttctgttctggtgaagggacccgggcaggcccccagcaccccatgctgacttggagaaccccagatctctggggcccagccaggcagggtgtgggggcagctgtgccaatctacctcacaggcccaccccctgccgggcatgccgtgggatcatgggcagggaaggctctgggggtcggagacaccgctgcttagcacccccagccagaacaccctgagggtctcggggctctggagagagtggggcgggaggaagaattggcaccttcctagggaaggagacgagcgcttcgccttgattcttccccgaccccaccccccaaaaaagctacttcttcattccgtggtacgattattttttttaactaaaggaagataaaatcctaaagcgtcaccaccctcttatatctattggtgacccattctactggcctaagattacaaacctacaacctgtcaaaccctgggtttcccacttaatcgctttgtcccatcccgttttcgagttgccaatacgtaacagcccccccgtctccttctaaacgtcgcc

SEQ ID NO: 420130 - DNA, 1127 bp, Homo sapiens
  misc_feature (990)..(990): n is a, c, g, or t
  misc_feature (996)..(996): n is a, c, g, or t
  misc_feature (1000)..(1000): n is a, c, g, or t
  misc_feature (1006)..(1006): n is a, c, g, or t
agtgtcaggaagaggaagagcgcggccggcggcgctgcgctgagagcaggggcccggccaaggcgagtgccgcgcgggccaccatggccacggacgagctggccaccaagctgagccggcggctgcagatggagggcgagggcggcggcgagaccccggagcagcccgggctgaacggggcagcggcggcggcggcgggggcacccgacgaggcggccgaggcgctgggcagcgcggactgcgagctgagcgccaagctgctgcggcgcgcagacctcaaccagggcatcggcgagccccagtcgcccagccgccgcgtcttcaacccctacaccgagttcaaggagttctccaggaagcagatcaaggacatggagaagatgttcaagcagtatgatgccgggcgggacggcttcatcgacctgatggagctaaaactcatgatggagaaacttggggcccctcagacccacctgggcctgaaaaacatgatcaaggaggtggatgaggactttgacagcaagctgagcttccgggagttcctcctgatcttccgcaaggcggcggccggggagcttcaggaggacagcgggctgtgcgtgctggcccgcctctctgagatcgacgtctccagtgagggtgtcaagggggccaagagcttctttgaggccaaggtccaggccatcaacgtgtccagccgcttcgaggaggagatcaaggcagagcaggaggaaaggaagaagcaggcggaggagatgaagcagcggaaagcggccttcaaggagctgcagtccacctttaagtagcgggggctgcagccgaccgccctgctccggccccagtgtggtgggcgagggtggcgcatgggaggccgagcctgaatccttgcctgtgtctgacgggaccactactaaaaacctaaaaatatctgtgaatggaaaaaaaaaaacaaaacaaaaaaaaaacaaaaaaaaacaaaaaaaaaacaanagaaanaaanaaaaanaaaaagacaaacaaagagaaaacacaaataacacaaagagaacacataggaaccccaaacacaagcaatactagcacacagggcgcgcggggcgcgggcggagcactgtactcacatcagc

SEQ ID NO: 420131 - DNA, 1522 bp, Homo sapiens
gcatgttgttggtcagggtttcagaatacgcgtgatgtcactgagaatgtttgctcacagtcaataattgtctttgtggatgtgataattttggagatacacttctggtcagaactcaggtgagataatcttgcaatactccaaatgcagatactccagccacccgcaaggttccaggaaaggacaatgtcctgcgagaaaatcaggaggcctccacttcctgggccacttgagaagttcctgggcatgtcactacatgttggttgactcagccatttctcatgctgttttgtttcttgcggtggccacttaaccccaaagaatgaagggaggatccacagtgaaagtgcctgagtttctctatgagaccagatgctgtcgaaaccaaacatcttttcctttgctctatgggaacattttagggtttgttttgcacagctggtttccagactagaagattaacaagtttgggtccacccctaagaatcagtggctgtcttttaaggtgaggagtgtgggcttaactgaggtcctttgagggagctataaaggagaaacaacctgggacatcccagttttcctattcctccactgttaatatctcatctaaaataattcatgagtttaaatggtaaatatatgctttaagctctacctttaaacttgtatgttattcaggcatctcttattaagatactgggtctctggatacccaaggaaatgttggctttttattcttatgtggttccaaatttacttctcttcagtttaattgtccatggtagtgctggcttcattgttaggttggagttattattttccttttagaacaacatgaattttattcaccttactattagaaaaaggaataactacagccagaaataacttcatttcctacaaggtataaaaagtggtcaagtgaatgtgaaggggcttttctacacaggaatatattatcgggaacaaagtatttcctgctgccttaactctttgggatgcataggataaaatgataaagaccattttaatatcagaaagggttgtcttattaatttttaaataaaacttcacatttcttaatggggagctcattcagaaactaaataatggtttctcaaagtgtggtcaggatacgatctgcatcagaatccttggaatgcttgttaaaaataccaattgctatgacaaaaccaagtctgctggaaactgcatttcagcaggtttcccatgttattctgatgtattttaacatttgagagccactaccaatcatctgtacagttcctactgttatgatcacaataagactaacatgaatttaataatctgaataatttttaaaatttaaataaacagaaattgaagttaaatttaaaaataaaaataacctcagaagttgaaaaaaaaattcgtctctctctactattgttcgtatatgtatagcagttacaaaaacctctcggggggggcccgggtcccaatttccccctttagggagcgtttttcacatgaacttgcc

SEQ ID NO: 420132 - DNA, 3510 bp, Homo sapiens
agcctccggtgtacctcgctgggaacgcacttcctgggacgctgagagggagacgctccaagaggctcctcagtgtgggcgagtaaaatgccctgcgtgtgagaagcaggctcagattattgctactctgtattcagatcttcatgtgtctcttctaagctgaataaagctgttttggaactgtcaggtacctcaaagctctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgtatgtcactattgctagtgctgggggcctgtttatgacttcccttatactatttatttggtattgtacatgcaaatctttgccttctcctttctggcaaccattgtactcccatccacccagtatgcatacttactcacagccctattcagcacgctctcgcctctctgccattgaaattgacattccagtagtttcacacaccacttaatggggaaatagttaattgttaaagaaaacttcttgtagcctcacattccccttgtgcaaagagctcttttggacctacatacattttcctttgtttttgaccaatcaatgaagccaaatttatatgtcctagtagaatgaagtgctgctagtttttatgagaagtatattatattaaatgtgaattttttaaattttgcttcttatactggaaggaattttagccttcatattgatatctaattaattatttaagtggaagaggcctgcatcacaattgaggtaatgtagagcaacatgttaaagaatgatggttagcagaagctgttgtatacaatcttcatgaaaatttcagtgtgtatttttctttttctataatacctttaactgcaaagaaaaggcagtttcaaatataagaaatttatttcaggtaagggtaatattttaatagtagtcaataatctagcttaaggctgtaactcttctatcggggctaattgtatgaataggtgtcagtatgttgaagattactttcttttgtgactttcttctacctcatgccactgtttaaaagtaaaatgtattttaatgatgttagaataagactaccattctaaatatcacctacttatgaataacatgtaataatttttaacattaatgattccataaattgtattattgggattagaatgtgctttatgacaggttagtgtttcctctgaggcagaaaactcttttttggagatatcttccatcaagcagtactcgtgcccatatacaatctcttagtggctaggagaaataaataaaagggccataatggtttgttctctttcagacataatttagtaggggacaagaagtctgttcttcagtgagtacactagagatttactctggtgactgccttttgagttatgggtgaagtaaggtatggctttaccataaccttgattcattcacccttgattcatttctcgcccccgtcactgattatttccttgagcatatatctctgcctaacactttagtaggtgctatagaggatacatgaaaagtatgagatctggttccatccagtaagacattttaatagagaagatcaaaatgttacctggcagttggggaataatctgacttcgttggcagttggccttaacttcttaatcattgatccaggaatatttcaaccagagacacaactttctggcagacagacaaattgtacaacaccaacaatatcctggaccttgaaattctgtttacttcagtccattgtatcctttaaggcacctgtgctagcctagattttgtaataacactgatttatgagaatggacaaaagtggtagggaaattgttccctctccacttctgaaagtatgatgatgtattaaggatggaggagttattaaaaatgtctcttctgatgaggtaacaattagatgaaaccatgttaaagctgagatgaacacttagaaattcagggatattgggtctttagccttatgaatttgagctgcttatttaattggtgtaatttactacatattagtactatattcgtaaggattttttattaaccattacagattttacaaacagctagttatatggtaaacagattattatgcctttttgcaattctgaatatgattctagtatttgtgtagatgtatttggtactttttcccctaattccaacactagtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtagaattttgagattaatgttaattttccctttttgttaatttcagtcccctctcactatgcttttgtccagaaggatcaagaattctaccatcccttgggtctttgtgtataaacaatgttaaataaaggtagactcagtctttaagatattagacagtttttttagtccatgggattgtaaatataaacattaactttcctataagaatattttggctttgtaatctatagcctcaaattggtatttattatggattcactagacaaacagctgtttccttattgtcttttttctttagtgtttctgatttgctatcagtagctgtttttaaagccatccaaggaaaataattatttacagtttttgaagtcacttttgagccctcatcaagctctcattgtgatgggagggatacctttttgttgttaaaagcctattattgttaaaggccttttatggaaaccaacttggaaaacaaccttaaatgtggatgtatcagatttggtttatccagccatgggagagaaaacaaacctaagtttactttacttgtacatatacactacaatggatagtatatttgctgtaaactacaatgtaaaacctcaataaaagtgcgctgtacttcttaatgtttattaaaagatgtatttttacaa

SEQ ID NO: 420133 - DNA, 438 bp, Homo sapiens
agcctccggtgtacctcgctgggaacgcacttcctgggacgctgagagggagacgctccaagaggctcctcagtgtgggcgagtaaaatgccctgcgtgtgagaagcaggctcagattattgctactctgtattcagatcttcatgtgtctcttctaagctgaataaagctgttttggaactgtcaggtacctcaaagcaatgtgctgtaaagaagagttgtcaattgtgcacagaagataagaaatatatgatgaatagataattgaaaagagatcctccagaaagagcagaaggaagtttcttcaatggcttccttcaggattttaatcatccttacagcctctttgagaatgattgaacttccaaattccctgaagttaaaattttaaattctattaaacattttttcgagtatttcattacttttacattatga

SEQ ID NO: 420134 - DNA, 389 bp, Homo sapiens
ctttttgtcaattacatgttgatagtaccttaagtcacttgagccctaaatattaaaatagcaacagtattaaaatctcagaaatctttttattattcatgaatgtttcatgtttaacattttaaaaattacgtaagtttttattgacttttcctagatagaatttgaaaagataaatttattttctcttctcatagtatatgatgaatagataattgaaaagagatcctccagaaagagcagaaggaagtttcttcaatggcttccttcaggattttaatcatccttacagcctctttgagaatgattgaacttccaaattccctgaagttaaaattttaaattctattaaacattttttcgagtatttcattacttttacattatga

SEQ ID NO: 420135 - DNA, 711 bp, Homo sapiens
agcctccggtgtacctcgctgggaacgcacttcctgggacgctgagagggagacgctccaagaggctcctcagtgtgggcgagtaaaatgccctgcgtgtgagaagcaggctcagattattgctactctgtattcagatcttcatgtgtctcttctaagctgaataaagctgttttggaactgtcaggtacctcaaagcgtaagtacgtcctttaattatatcttatttccctccctcctgctaccacatctgccaacaatgactctttttttttctcttgttcaacaaaatagaggtataggacagacctctcttgtgagtacaatgactgatgacttacagtttctaagaaaacccaaattataggtagaaggaactctcaatgttaccatcaagaattaagttagggctgggcatggtggctcagccctgtaaccctagcgctttgagaggctgaggtggaaggatcccttgagcccaggagtttgagaccatcctgggcaacatagcgagatcctgactgtatgagaaaattttaaaaaattagccagttgtggtggtacatgcctatagtcccagctactctggaagctgaggtgggaggattgcttgagcctcggaggtcgaggctgcagtgagccatgattgtgtcattgcactctagcctgggcaacagagtaagacttgtttcaaaaaaaaaagaaagaaaa

SEQ ID NO: 420136 - DNA, 695 bp, Homo sapiens
tgctgttctcatgatagtgagtaagttattacaagatctgatggttttataaagggttattccttctttgctcagcacttcttcctgctgccatgtgaagaagaacatatttgcttccccttctgccataactcggaaaggtcagccccccgctgcaagttcttagattcctggaggatctgcagagtcaacattaggagtatccatccattcaccaaggccatcaggaatgtgctgccccaggaacaatcagaaaccaagagatgggaatgaagagggtgagtgatctggagtcctgaggtgggtgccccacatgctccagcgttttttttccttttaatggtgccatcctggtgcactggaattttcatctcaaaagttgtcatttggtgttggtgggaagacattttaaaggttctagatggttttggtgaaactcagttaaattggactcagattaatttggtttatctgaaatatgaaaggtagattcaaagttttaaatttgaggaaaagcatggtttctcccccatcactttctgcatgacctatgacatataagctttttgttgtgaataagccattgggttttgttctaatcagacccactcaatggtcatagttcctctttcttaagttttttaaggtcttagttaataaaatgctttatttgttctttttcataaaaaaattac

SEQ ID NO: 420137 - DNA, 3719 bp, Homo sapiens
agcctccggtgtacctcgctgggaacgcacttcctgggacgctgagagggagacgctccaagaggctcctcagtgtgggcgagtaaaatgccctgcgtgtgagaagcaggctcagattattgctactctgtattcagatcttcatgtgtctcttctaagctgaataaagctgttttggaactgtcaggtacctcaaagctctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgtatgtcactattgctagtgctgggggcctgtttatgacttcccttatactatttatttggtattgtacatgcaaatctttgccttctcctttctggcaaccattgtactcccatccacccagtatgcatacttactcacagccctattcagcacgctctcgcctctctgccattgaaattgacattccagtagtttcacacaccacttaatggggaaatagttaattgttaaagaaaacttcttgtagcctcacattccccttgtgcaaagagctcttttggacctacatacattttcctttgtttttgaccaatcaatgaagccaaatttatatgtcctagtagaatgaagtgctgctagtttttatgagaagtatattatattaaatgtgaattttttaaattttgcttcttatactggaaggaattttagccttcatattgatatctaattaattatttaagtggaagaggcctgcatcacaattgaggtaatgtagagcaacatgttaaagaatgatggttagcagaagctgttgtatacaatcttcatgaaaatttcagtgtgtatttttctttttctataatacctttaactgcaaagaaaaggcagtttcaaatataagaaatttatttcaggtaagggtaatattttaatagtagtcaataatctagcttaaggctgtaactcttctatcggggctaattgtatgaataggtgtcagtatgttgaagattactttcttttgtgactttcttctacctcatgccactgtttaaaagtaaaatgtattttaatgatgttagaataagactaccattctaaatatcacctacttatgaataacatgtaataatttttaacattaatgattccataaattgtattattgggattagaatgtgctttatgacaggttagtgtttcctctgaggcagaaaactcttttttggagatatcttccatcaagcagtactcgtgcccatatacaatctcttagtggctaggagaaataaataaaagggccataatggtttgttctctttcagacataatttagtaggggacaagaagtctgttcttcagtgagtacactagagatttactctggtgactgccttttgagttatgggtgaagtaaggtatggctttaccataaccttgattcattcacccttgattcatttctcgcccccgtcactgattatttccttgagcatatatctctgcctaacactttagtaggtgctatagaggatacatgaaaagtatgagatctggttccatccagtaagacattttaatagagaagatcaaaatgttacctggcagttggggaataatctgacttcgttggcagttggccttaacttcttaatcattgatccaggaatatttcaaccagagacacaactttctggcagacagacaaattgtacaacaccaacaatatcctggaccttgaaattctgtttacttcagtccattgtatcctttaaggcacctgtgctagcctagattttgtaataacactgatttatgagaatggacaaaagtggtagggaaattgttccctctccacttctgaaagtatgatgatgtattaaggatggaggagttattaaaaatgtctcttctgatgaggtaacaattagatgaaaccatgttaaagctgagatgaacacttagaaattcagggatattgggtctttagccttatgaatttgagctgcttatttaattggtgtaatttactacatattagtactatattcgtaaggattttttattaaccattacagattttacaaacagctagttatatggtaaacagattattatgcctttttgcaattctgaatatgattctagtatttgtgtagatgtatttggtactttttcccctaattccaacactagtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtagaattttgagattaatgttaattttccctttttgttaatttcagtcccctctcactatgcttttgtccagaaggatcaagaattctaccatcccttgggtctttgtgtataaacaatgttaaataaaggtagactcagtctttaagatattagacagtttttttagtccatgggattgtaaatataaacattaactttcctataagaatattttggctttgtaatctatagcctcaaattggtatttattatggattcactagacaaacagctgtttccttattgtcttttttctttagtgtttctgatttgctatcagtagctgtttttaaagccatccaaggaaaataattatttacagtttttgaagtcacttttgagccctcatcaagctctcattgtgatgggagggatacctttttgttgttaaaagcctattattgttaaaggccttttatggaaaccaacttggaaaacaaccttaaatgtggatgtatcagatttggtttatccagccatgggagagaaaacaaacctaagtttactttacttgtacatatacactacaatggatagtatatttgctgtaaactacaatgtaaaacctcaataaaagtgcgctgtacttcttaatgtttattaaaagatgtatttttacaaaaaaaaaaaaaataaaaaacaaaaaaaaaacaaaacaacaccaaaacctcaaccaaacatacaaaactacacacaaacaaccaactccaccaaacatacatctagagatgcggggcccgcacctatactactacgcgtgcccctacgccactccgcctctctgccacactgcactctaccgtgcctctatacacacggaggccgacaat

SEQ ID NO: 420138 - DNA, 1429 bp, Homo sapiens
cagtccgtaccagatggaaggtctagcctcggtttccggagaatgtgtggctatatctctgtaatccagtttagaaagctggcctgcagggctgagatccttccacggcctcctcgggtaggacggctctgagtaggcttgaaattctgtttacttcagtccattgtatcctttaaggcacctgtgctagcctagattttgtaataacactgatttatgagaatggacaaaagtggtagggaaattgttccctctccacttctgaaagtatgatgatgtattaaggatggaggagttattaaaaatgtctcttctgatgaggtaacaattagatgaaaccatgttaaagctgagatgaacacttagaaattcagggatattgggtctttagccttatgaatttgagctgcttatttaattggtgtaatttactacatattagtactatattcgtaaggattttttattaaccattacagattttacaaacagctagttatatggtaaacagattattatgcctttttgcaattctgaatatgattctagtatttgtgtagatgtatttggtactttttcccctaattccaacactagtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtagaattttgagattaatgttaattttccctttttgttaatttcagtcccctctcactatgcttttgtccagaaggatcaagaattctaccatcccttgggtctttgtgtataaacaatgttaaataaaggtagactcagtctttaagatattagacagtttttttagtccatgggattgtaaatataaacattaactttcctataagaatattttggctttgtaatctatagcctcaaattggtatttattatggattcactagacaaacagctgtttccttattgtcttttttctttagtgtttctgatttgctatcagtagctgtttttaaagccatccaaggaaaataattatttacagtttttgaagtcacttttgagccctcatcaagctctcattgtgatgggagggatacctttttgttgttaaaagcctattattgttaaaggccttttatggaaaccaacttggaaaacaaccttaaatgtggatgtatcagatttggtttatccagccatgggagagaaaacaaacctaagtttactttacttgtacatatacactacaatggatagtatatttgctgtaaactacaatgtaaaacctcaataaaagtgcgctgtacttcttaatgtttattaaaagatgtatttttacaa

SEQ ID NO: 420139 - DNA, 697 bp, Homo sapiens
agcctccggtgtacctcgctgggaacgcacttcctgggacgctgagagggagacgctccaagaggctcctcagtgtgggcgagtaaaatgccctgcgtgtgagaagcaggctcagattattgctactctgtattcagatcttcatgtgtctcttctaagctgaataaagctgttttggaactgtcaggtacctcaaagcaatgtgctgtaaagaagagttgtcaattgtgcacagaagataagaaatgtgtttggtgtagtgaagaaaaagcatgcaaaaaatactgttttccctatttcggttgtcgattcagttctatatattggttaaactgtaaagttgacatgtttggaatcatgatgcttctactcattgcagtattaattacaggattcgtttggtactgctgcgcctatcacttttacctgcaggatttgaacagaaatcgtgtctatttttatggaagacgagaaacagttcctattcacgaccgcagtgctactgtatatgatgaatagataattgaaaagagatcctccagaaagagcagaaggaagtttcttcaatggcttccttcaggattttaatcatccttacagcctctttgagaatgattgaacttccaaattccctgaagttaaaattttaaattctattaaacattttttcgagtatttcattacttttacattatga

SEQ ID NO: 420140 - DNA, 605 bp, Homo sapiens
agcctccggtgtacctcgctgggaacgcacttcctgggacgctgagagggagacgctccaagaggctcctcagtgtgggcgagtaaaatgccctgcgtgtgagaagcaggctcagattattgctactctgtattcagatcttcatgtgtctcttctaagctgaataaagctgttttggaactgtcaggtacctcaaagccggaaaggtcagccccccgctgcaagttcttagattcctggaggatctgcagagtcaacattaggagtatccatccattcaccaaggccatcaggaatgtgctgccccaggaacaatcagaaaccaagagatgggaatgaagagggtgagtgatctggagtcctgagaatgtgctgtaaagaagagttgtcaattgtgcacagaagataagaaatatatgatgaatagataattgaaaagagatcctccagaaagagcagaaggaagtttcttcaatggcttccttcaggattttaatcatccttacagcctctttgagaatgattgaacttccaaattccctgaagttaaaattttaaattctattaaacattttttcgagtatttcattacttttacattatga

SEQ ID NO: 420141 - DNA, 542 bp, Homo sapiens
agcctccggtgtacctcgctgggaacgcacttcctgggacgctgagagggagacgctccaagaggctcctcagtgtgggcgagtaaaatgccctgcgtgtgagaagcaggctcagattattgctactctgtattcagatcttcatgtgtctcttctaagctgaataaagctgttttggaactgtcaggtacctcaaagccggaaaggtcagccccccgctgcaagttcttagattcctggaggatctgcagagtcaacattaggagtatccatccattcaccaaggccatcaggaatgtgctgaatgtgctgtaaagaagagttgtcaattgtgcacagaagataagaaatatatgatgaatagataattgaaaagagatcctccagaaagagcagaaggaagtttcttcaatggcttccttcaggattttaatcatccttacagcctctttgagaatgattgaacttccaaattccctgaagttaaaattttaaattctattaaacattttttcgagtatttcattacttttacattatga

SEQ ID NO: 420142 - DNA, 438 bp, Homo sapiens
agcctccggtgtacctcgctgggaacgcacttcctgggacgctgagagggagacgctccaagaggctcctcagtgtgggcgagtaaaatgccctgcgtgtgagaagcaggctcagattattgctactctgtattcagatcttcatgtgtctcttctaagctgaataaagctgttttggaactgtcaggtacctcaaagcagatggggtctcgctatgttgcccaatctggtctcaaactcctgggctcaagctatcctcccaccgcagcctccccaagtgctggaattacaggcatgagccacagcacctggcctggaatttattaataatggagttatacatcctgatcttgtttctcactccatttacatttcaggaatcagtgttacagggcagtttgattggagaaatctcaattacattgaaattccaattat

SEQ ID NO: 420143 - DNA, 3456 bp, Homo sapiens
agcctccggtgtacctcgctgggaacgcacttcctgggacgctgagagggagacgctccaagaggctcctcagtgtgggcgagtaaaatgccctgcgtgtgagaagcaggctcagattattgctactctgtattcagatcttcatgtgtctcttctaagctgaataaagctgttttggaactgtcaggtacctcaaagctctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgtatgtcactattgctagtgctgggggcctgtttatgacttcccttatactatttatttggtattgtacatgcaaatctttgccttctcctttctggcaaccattgtactcccatccacccagtatgcatacttactcacagccctattcagcacgctctcgcctctctgccattgaaattgacattccagtagtttcacacaccacttaatggggaaatagttaattgttaaagaaaacttcttgtagcctcacattccccttgtgcaaagagctcttttggacctacatacattttcctttgtttttgaccaatcaatgaagccaaatttatatgtcctagtagaatgaagtgctgctagtttttatgagaagtatattatattaaatgtgaattttttaaattttgcttcttatactggaaggaattttagccttcatattgatatctaattaattatttaagtggaagaggcctgcatcacaattgaggtaatgtagagcaacatgttaaagaatgatggttagcagaagctgttgtatacaatcttcatgaaaatttcagtgtgtatttttctttttctataatacctttaactgcaaagaaaaggcagtttcaaatataagaaatttatttcaggtaagggtaatattttaatagtagtcaataatctagcttaaggctgtaactcttctatcggggctaattgtatgaataggtgtcagtatgttgaagattactttcttttgtgactttcttctacctcatgccactgtttaaaagtaaaatgtattttaatgatgttagaataagactaccattctaaatatcacctacttatgaataacatgtaataatttttaacattaatgattccataaattgtattattgggattagaatgtgctttatgacaggttagtgtttcctctgaggcagaaaactcttttttggagatatcttccatcaagcagtactcgtgcccatatacaatctcttagtggctaggagaaataaataaaagggccataatggtttgttctctttcagacataatttagtaggggacaagaagtctgttcttcagtgagtacactagagatttactctggtgactgccttttgagttatgggtgaagtaaggtatggctttaccataaccttgattcattcacccttgattcatttctcgcccccgtcactgattatttccttgagcatatatctctgcctaacactttagtaggtgctatagaggatacatgaaaagtatgagatctggttccatccagtaagacattttaatagagaagatcaaaatgttacctggcagttggggaataatctgacttcgttggcagttggccttaacttcttaatcattgatccaggaatatttcaaccagagacacaactttctggcagacagacaaattgtacaacaccaacaatatcctggaccttgaaattctgtttacttcagtccattgtatcctttaaggcacctgtgctagcctagattttgtaataacactgatttatgagaatggacaaaagtggtagggaaattgttccctctccacttctgaaagtatgatgatgtattaaggatggaggagttattatgaacacttagaaattcagggatattgggtctttagccttatgaatttgagctgcttatttaattggtgtaatttactacatattagtactatattcgtaaggattttttattaaccattacagattttacaaacagctagttatatggtaaacagattattatgcctttttgcaattctgaatatgattctagtatttgtgtagatgtatttggtactttttcccctaattccaacactagtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtagaattttgagattaatgttaattttccctttttgttaatttcagtcccctctcactatgcttttgtccagaaggatcaagaattctaccatcccttgggtctttgtgtataaacaatgttaaataaaggtagactcagtctttaagatattagacagtttttttagtccatgggattgtaaatataaacattaactttcctataagaatattttggctttgtaatctatagcctcaaattggtatttattatggattcactagacaaacagctgtttccttattgtcttttttctttagtgtttctgatttgctatcagtagctgtttttaaagccatccaaggaaaataattatttacagtttttgaagtcacttttgagccctcatcaagctctcattgtgatgggagggatacctttttgttgttaaaagcctattattgttaaaggccttttatggaaaccaacttggaaaacaaccttaaatgtggatgtatcagatttggtttatccagccatgggagagaaaacaaacctaagtttactttacttgtacatatacactacaatggatagtatatttgctgtaaactacaatgtaaaacctcaataaaagtgcgctgtacttcttaatgtttattaaaagatgtatttttacaa

SEQ ID NO: 420144 - DNA, 1756 bp, Homo sapiens
tcggaacacacagatgggcacacctctgtccagagtgttattgagaagttgcaggaagaaaatcgactgttaaaacagaaggtgactcacgttgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcagattctcgcttacaaggatgacttcatgtcagaaagggccgatcgggaacgggctcaaagtaggattcaagaactggaggaaaaggtcgcctctttgctgcaccaggtgtcctggagacaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggtccagagaggccagggggaccttcagtgccctcactgcctgcagtgcttcagtgacgagcaaggggaagagctcctcaggcatgtggccgagtgctgccagtgaccgagactcacccgtgcccttgcggcctcctggcccggtgcagctgccctcagggacagggtgggtgctctcagatgccatgggttgagctctactgagagccaaggcccctagaatagttgcggggcactctgatcgttcactttggtccctttggctatggaacaggctgggtcacagggaactgccagtgaggctggaggctggaggtggagatggggtcaggaacatctggcagagggaggtcccagtctgtgtctccatcaggcttaagccagagctatctggtgctggtgtgccagcccctcccccagcctgcctagaaaggggtggctgcctgagggagtcacttgtatggtccccagggtgggagccccatcctgttctatggaataaagcgtcgcctctctgcctcgaaccagtcaaatggagtattgcggctgcacgtcacactagggtggccacccccgccattgcgagccacatgtctgcactgagaaactgcatttcagtagcatttgtcatccagccggaagttaaagcacacttactttattcacctatttttataataaacgttcttgctgctgtgactgctctgagaatttgtgttggaagctggggtgcagggactgaacagtatttacagcagctggcatgggaaaacactcctgctgttgccttctgccagggcaccaagacaagggggtcagtgggagcctggctgtattagggttctctagagggacagaactaatggaacagatagatatataaaggggagtgtgtcaagtattaactcacacgatcacaagttcccacaataggccgtctgcaggctgaggaacaaggagagccagtcccgagttccgaaactgaagaacttgggagtcctatgttcaagggcaggaagcatccagcacggagcaagatgtaggctgggaggccaggccagtctctcttttcacatttttctgcctgctttattctggccacgctggcagctgattagatggtgcccaccccgattgag

SEQ ID NO: 420145 - DNA, 1410 bp, Homo sapiens
tcggaacacacagatgggcacacctctgtccagagtgttattgagaagttgcaggaagaaaatcgactgttaaaacagaaggtgactcacgttgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcagattctcgcttacaaggatgacttcatgtcagaaagggccgatcgggaacgggctcaaagtaggattcaagaactggaggaaaaggtcgcctctttgctgcaccaggtgtcctggagacaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggtccagagaggccagggggaccttcagtgccctcactgcctgcagtgcttcagtgacgagcaaggggaagagctcctcaggcatgtggccgagtgctgccagtgaccgagactcacccgtgcccttgcggcctcctggcccggtgcagctgccctcagggacagggtgggtgctctcagatgccatgggttgagctctactgagagccaaggcccctagaatagttgcggggcactctgatcgttcactttggtccctttggctatggaacaggctgggtcacagggaactgccagtgaggctggaggctggaggtggagatggggtcaggaacatctggcagagggaggtcccagtctgtgtctccatcaggcttaagccagagctatctggtgctggtgtgccagcccctcccccagcctgcctagaaaggggtggctgcctgagggagtcacttgtatggtccccagggtgggagccccatcctgttctatggaataaagcgtcgcctctctgcctcgaaccagtcaaatggagtattgcggctgcacgtcacactagggtggccacccccgccattgcgagccacatgtctgcactgagaaactgcatttcagtagcatttgtcatccagccggaagttaaagcacacttactttattcacctatttttataataaacgttcttgctgctgtgaaaacaaaaaaaaacccgggtcctttgggggggaaaggtgtggagcctgtctcgggcccgccctttgtacaggacgggcccaaggggaagacgtg

SEQ ID NO: 420146 - DNA, 405 bp, Homo sapiens
agatctcccggctcaacagacagttggaagagaaaataaatgactgtgccgaagtgaagcaggagctggcggcctccaggacggcccgggatgctgcgttggagcgggtgcagatgctggaacagcaggtgtctgtccctcgggctccggacggcactgaccagatgtctgctggccggtggtggccgaaatcatgggacaggctgggctgaaggcttggtggcactgagtgggcagtggtcacggtgggggtgggagaagcctggtggggcgcttcctccttccttgagcagaaatgtgtgtctcgcctctcttcagattctcgcttacaaggatgacttcatgtcagaaagggccgatcgggaacgggctcaaagtaggattcaagaactggaggaaaaggtc

SEQ ID NO: 420147 - DNA, 623 bp, Homo sapiens
cccagcggagttcctgggtgtttcatgggagcacccgccctgtcccctggaggaacacactgagggttggtgggcaggtgacccaaagatatggatccccctgacttggtcgacattgcttccccctttctgcaacccctgaaaaggggccctagcctaacttccacctagatgtgtacctgtagcatgaagtgccaggtactgtttctggggaatattcttttgggtgtgaggtggcagacaggcctgcccccatggggaaccctcggcctgagaaccaagcactgggcagcttcagtctgtgggcccagaggcttctcaactttcacccagtcccttccaaaggccacgtgggccagaagactctgcctcagaccctcctgggcccgcagctgaaccctgatcctcatgccacattcgagggtcaggaggcatccagaaacaaggactggaagggcctcagaggtcatctagatagtccagcttttccatcccattttatagatgaggaaatttgaggcccaaagacatgcaatgaactagttcccacgcccgtgtccctgccgcaactatgagggaagacacgtggggcctgtgctacccagttgcctgagcccagcgcc

SEQ ID NO: 420148 - DNA, 906 bp, Homo sapiens
aagtgtggccacttcctcttgcctgtcctgactcaccctggctgctgcccattgtggctgccatggaaatacaactcgaggagaacccagaccaggacagggaggccatgttctgggtggcagtggagcctggcaaggtgccctcctggcctgggactgctgtggcagaggaagcatgaggtggggcctggcctgcccagctcagagctgaggtgcccccttggttttttacctccctgctccctggctggcccactgcacccacgcactcaacgcagtggcttcgctcctcctccaggatggctggaggtgggaccattgccaggatggcctcaagtgcccagccctcctggaagactcagtttccctctttgtcccatgcagaggtgcagagattcattattgtaagtggggtgacaacatggtgaggggttggagtgtgggctctggggtagaatcctgacctggttactcctggctgcgagacttggggcaaggtatttaactcctctgtacttcaatcccctcctctgcaaaataacagtccctacttcataggattgttgtgaggatggcatggcacctgggccagctctctgctatagggtttgtgcccaacctggagcctggctgaatgcaaagcgttcggggactttcccgcaacgtcttaagctgttgagtgctgtgcacacgtaaagcacaatcattgtggacagtcagtgtggtcagagtgagaggataatctatcttgggattctcaaatgactagtatcagcagatcctggctacaattcacagatgtttcccctgtggaagctgggttttcatccttgcctttcctgttcatccttcctctttagttattttgcacatgcacacaggttcaccatacacaaaggtagcatg

SEQ ID NO: 420149 - DNA, 3139 bp, Homo sapiens
  misc_feature (1)..(1): n is a, c, g, or t
  misc_feature (4)..(4): n is a, c, g, or t
ngcncggccgcggcccggcccctgcggcccgcgcggagcggacgcgcgtggcgctgcccggtgggaccatccgtgaagccggtgccaggatgcaccgggggtgtggatgaccggccgcccagccccagcacggcccggtcccgcatgccaccgccccgcgaggaccgctctccaagggctgcctggggccccgcgcccgtactctcctaacccggagctctcggcagcccattgctgcctggctacccggggaggaggaggcgcaggagtgagctgcccgagaccgcagggcaagtaagcggctgacggcggaaagaccctggggaaggggctttgcggccggctagaaacattttccccaagcggctccgcaaaatgaccagcctgttccgccggagcagcagcggcagcggcgggggtggcaccgccggggcacgcgggggcgggggaggcacggccgccccccaggagctcaacaacagccggcctgcccgccaggtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccggccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccaaaatgaggaagtcaaagaggaaacacttgttgaagcatcagtcgctgggggctgccgcgtcaacagccaacctcctggatgatgtggagggccacgcgtgtgatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctccctttaaaaaaaaaaaaatccagaaagcagataaaagttggaatatggaaaagggcaagatgacccccaccagaggctctttggcctgaaggtggagtctctgcctccgtccgttctctatctctcctgtcacagactctgcctgaccccctttcctcagctcccttctggtcccccttcctcagctccctccgggcacttgtgcccttcccttccatgtcctcctgtatctcagccttcccccggggctgctggcccagcacacgagccctgcacccagcctgggtgggaggtccctggccagtcccccaggaactctgaggagctatgggctactgcaaagcatctgccgactgccctgccccgtctggcctcatcaggctgctgctgttagggatgggctcactcccagcagctcccggtcacccagcagggatggggagggtggccaccctggagctggaggactctggggaggcagggtctttaatttggcagcagacaaaagccagttctggagtcacaccacagtaggggctcacaggggctctgactccccagctggactggaagccctgctgtccgagggtgggcagcggtgggtcctggagtgacccctttgagcaggtgcagggctaaagagcaaggcggaaaggccgccagcctgggtgagcgcctagggcataagggcttgctgggtgcccctgagaagggcgggtgatctgaggaggagaactctgattctaggaacgcttacacggcactgaccactgccacggggagggaggctgcccagcccgtggccccgccctggacatgggagcgcgcagaccttccggagagccgggaagcctgggcaggcacgaggcttcggcgcggctctgggaggttgggagtggcatccgatccttggccgggccctggtggcctccgtggccccaagatcacaagggcgtagcgaaggcgagccggcgatcgcacctcgtcccgcccaccctgcccggactcgcaacgccgagcttggggagggccgggacgcgcagccgccgccgagcgtgaccaagtttggaaacgcgcgcggggccgggacgctggctcggggggccctgccgaggagcggtcgccccctccgctgctccccgcgccaggcctggggccctggagggaggggggggggtctccgaggagtgcctcggtaccccagctcgagttctcgacgggtctctgagccttccccgcgccaggacccggcgcactgtgggggaagccccagccccatgtctgttgagtgttgctttgttattttttttcctcctatgtgtgggttttttcttggagctgtttcataggaattcctgtaataaacagttggtgttc

SEQ ID NO: 420150 - DNA, 3453 bp, Homo sapiens
aagtgtggccacttcctcttgcctgtcctgactcaccctggctgctgcccattgtggctgccatggaaatacaactcgaggagaacccagaccaggacagggaggccatgttctgggtggcagtggagcctggcaaggtgccctcctggcctgggactgctgtggcagaggaagcatgaggtggggcctggcctgcccagctcagagctgaggtgcccccttggttttttacctccctgctccctggctggcccactgcacccacgcactcaacgcagtggcttcgctcctcctccaggatggctggaggtgggaccattgccaggatggcctcaagtgcccagccctcctggaagactcagtttccctctttgtcccatgcagaggtgcagagattcattattgtgggaccatccgtgaagccggtgccaggatgcaccgggggtgtggatgaccggccgcccagccccagcacggcccggtcccgcatgccaccgccccgcgaggaccgctctccaagggctgcctggggccccgcgcccgtactctcctaacccggagctctcggcagcccattgctgcctggctacccggggaggaggaggcgcaggagtgagctgcccgagaccgcagggcaagtaagcggctgacggcggaaagaccctggggaaggggctttgcggccggctagaaacattttccccaagcggctccgcaaaatgaccagcctgttccgccggagcagcagcggcagcggcgggggtggcaccgccggggcacgcgggggcgggggaggcacggccgccccccaggagctcaacaacagccggcctgcccgccaggtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccggccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagaggatcgcgcttttcctgcagaacgaggagttcatgaaggagctgcaacggaaccgcgacttcctcctcgctctggagagagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccaaaatgaggaagtcaaagaggaaacacttgttgaagcatcagtcgctgggggctgccgcgtcaacagccaacctcctggatgatgtggagggccacgcgtgtgatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctccctttaaaaaaaaaaaaatccagaaagcagataaaagttggaatatggaaaagggcaagatgacccccaccagaggctctttggcctgaaggtggagtctctgcctccgtccgttctctatctctcctgtcacagactctgcctgaccccctttcctcagctcccttctggtcccccttcctcagctccctccgggcacttgtgcccttcccttccatgtcctcctgtatctcagccttcccccggggctgctggcccagcacacgagccctgcacccagcctgggtgggaggtccctggccagtcccccaggaactctgaggagctatgggctactgcaaagcatctgccgactgccctgccccgtctggcctcatcaggctgctgctgttagggatgggctcactcccagcagctcccggtcacccagcagggatggggagggtggccaccctggagctggaggactctggggaggcagggtctttaatttggcagcagacaaaagccagttctggagtcacaccacagtaggggctcacaggggctctgactccccagctggactggaagccctgctgtccgagggtgggcagcggtgggtcctggagtgacccctttgagcaggtgcagggctaaagagcaaggcggaaaggccgccagcctgggtgagcgcctagggcataagggcttgctgggtgcccctgagaagggcgggtgatctgaggaggagaactctgattctaggaacgcttacacggcactgaccactgccacggggagggaggctgcccagcccgtggccccgccctggacatgggagcgcgcagaccttccggagagccgggaagcctgggcaggcacgaggcttcggcgcggctctgggaggttgggagtggcatccgatccttggccgggccctggtggcctccgtggccccaagatcacaagggcgtagcgaaggcgagccggcgatcgcacctcgtcccgcccaccctgcccggactcgcaacgccgagcttggggagggccgggacgcgcagccgccgccgagcgtgaccaagtttggaaacgcgcgcggggccgggacgctggctcggggggccctgccgaggagcggtcgccctcagaggacccgggcaagctggcactggaagacgacaaagaaacaaaaagaaaagacagaccacagaaaacaaccgcgaggaaacacaagacaaacaagaaacagcacaaccaagaacaaagagcagcaagcggcagcc

SEQ ID NO: 420151 - DNA, 2795 bp, Homo sapiens
aagtgtggccacttcctcttgcctgtcctgactcaccctggctgctgcccattgtggctgccatggaaatacaactcgaggagaacccagaccaggacagggaggccatgttctgggtggcagtggagcctggcaaggtgccctcctggcctgggactgctgtggcagaggaagcatgaggtggggcctggcctgcccagctcagagctgaggtgcccccttggttttttacctccctgctccctggctggcccactgcacccacgcactcaacgcagtggcttcgctcctcctccaggatggctggaggtgggaccattgccaggatggcctcaagtgcccagccctcctggaagactcagtttccctctttgtcccatgcagaggtgcagagattcattattgtgggaccatccgtgaagccggtgccaggatgcaccgggggtgtggatgaccggccgcccagccccagcacggcccggtcccgcatgccaccgccccgcgaggaccgctctccaagggctgcctggggccccgcgcccgtactctcctaacccggagctctcggcagcccattgctgcctggctacccggggaggaggaggcgcaggagtgagctgcccgagaccgcagggcaagtaagcggctgacggcggaaagaccctggggaaggggctttgcggccggctagaaacattttccccaagcggctccgcaaaatgaccagcctgttccgccggagcagcagcggcagcggcgggggtggcaccgccggggcacgcgggggcgggggaggcacggccgccccccaggagctcaacaacagccggcctgcccgccaggtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccggccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagaggatcgcgcttttcctgcagaacgaggagttcatgaaggagctgcaacggaaccgcgacttcctcctcgctctggagagagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccaaaatgaggaagtcaaagaggaaacacttgttgaagcatcagtcgctgggggctgccgcgtcaacagccaacctcctggatgatgtggagggccacgcgtgtgatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctccctttaaaaaaaaaaaaatccagaaagcagataaaagttggaatatggaaaagggcaagatgacccccaccagaggctctttggcctgaaggtggagtctctgcctccgtccgttctctatctctcctgtcacagactctgcctgaccccctttcctcagctcccttctggtcccccttcctcagctccctccgggcacttgtgcccttcccttccatgtcctcctgtatctcagccttcccccggggctgctggcccagcacacgagccctgcacccagcctgggtgggaggtccctggccagtcccccaggaactctgaggagctatgggctactgcaaagcatctgccgactgccctgccccgtctggcctcatcaggctgctgctgttagggaggggggggggtctccgaggagtgcctcggtaccccagctcgagttctcgacgggtctctgagccttccccgcgccaggacccggcgcactgtgggggaagccccagccccatgtctgttgagtgttgctttgttattttttttcctcctatgtgtgggttttttcttggagctgtttcataggaattcctgtaataaacagttggtgttc

SEQ ID NO: 420152 - DNA, 3177 bp, Homo sapiens
  misc_feature (1)..(1): n is a, c, g, or t
  misc_feature (4)..(4): n is a, c, g, or t
ngcncggccgcggcccggcccctgcggcccgcgcggagcggacgcgcgtggcgctgcccggtgggaccatccgtgaagccggtgccaggatgcaccgggggtgtggatgaccggccgcccagccccagcacggcccggtcccgcatgccaccgccccgcgaggaccgctctccaagggctgcctggggccccgcgcccgtactctcctaacccggagctctcggcagcccattgctgcctggctacccggggaggaggaggcgcaggagtgagctgcccgagaccgcagggcaagtaagcggctgacggcggaaagaccctggggaaggggctttgcggccggctagaaacattttccccaagcggctccgcaaaatgaccagcctgttccgccggagcagcagcggcagcggcgggggtggcaccgccggggcacgcgggggcgggggaggcacggccgccccccaggagctcaacaacagccggcctgcccgccaggtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccggccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagaggatcgcgcttttcctgcagaacgaggagttcatgaaggagctgcaacggaaccgcgacttcctcctcgctctggagagagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccgctgggggctgccgcgtcaacagccaacctcctggatgatgtggagggccacgcgtgtgatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctccctttaaaaaaaaaaaaatccagaaagcagataaaagttggaatatggaaaagggcaagatgacccccaccagaggctctttggcctgaaggtggagtctctgcctccgtccgttctctatctctcctgtcacagactctgcctgaccccctttcctcagctcccttctggtcccccttcctcagctccctccgggcacttgtgcccttcccttccatgtcctcctgtatctcagccttcccccggggctgctggcccagcacacgagccctgcacccagcctgggtgggaggtccctggccagtcccccaggaactctgaggagctatgggctactgcaaagcatctgccgactgccctgccccgtctggcctcatcaggctgctgctgttagggatgggctcactcccagcagctcccggtcacccagcagggatggggagggtggccaccctggagctggaggactctggggaggcagggtctttaatttggcagcagacaaaagccagttctggagtcacaccacagtaggggctcacaggggctctgactccccagctggactggaagccctgctgtccgagggtgggcagcggtgggtcctggagtgacccctttgagcaggtgcagggctaaagagcaaggcggaaaggccgccagcctgggtgagcgcctagggcataagggcttgctgggtgcccctgagaagggcgggtgatctgaggaggagaactctgattctaggaacgcttacacggcactgaccactgccacggggagggaggctgcccagcccgtggccccgccctggacatgggagcgcgcagaccttccggagagccgggaagcctgggcaggcacgaggcttcggcgcggctctgggaggttgggagtggcatccgatccttggccgggccctggtggcctccgtggccccaagatcacaagggcgtagcgaaggcgagccggcgatcgcacctcgtcccgcccaccctgcccggactcgcaacgccgagcttggggagggccgggacgcgcagccgccgccgagcgtgaccaagtttggaaacgcgcgcggggccgggacgctggctcggggggccctgccgaggagcggtcgccccctccgctgctccccgcgccaggcctggggccctggagggaggggggggggtctccgaggagtgcctcggtaccccagctcgagttctcgacgggtctctgagccttccccgcgccaggacccggcgcactgtgggggaagccccagccccatgtctgttgagtgttgctttgttattttttttcctcctatgtgtgggttttttcttggagctgtttcataggaattcctgtaataaacagttggtgttc

SEQ ID NO: 420153 - DNA, 2514 bp, Homo sapiens
cccagcggagttcctgggtgtttcatgggagcacccgccctgtcccctggaggaacacactgagggttggtgggcaggtgacccaaagatatggatccccctgacttggtcgacattgcttccccctttctgcaacccctgaaaaggggccctagcctaacttccacctagatgtgtacctgtagcatgaagtgccaggtactgtttctggggaatattcttttgggtgtgaggtggcagacaggcctgcccccatggggaaccctcggcctgagaaccaagcactgggcagcttcagtctgtgggcccagaggcttctcaactttcacccagtcccttccaaaggccacgtgggccagaagactctgcctcagaccctcctgggcccgcagctgaaccctgatcctcatgccacattcgagggtcaggaggcatccagaaacaaggactggaagggcctcagaggtcatctagatagtccagcttttccatcccattttatagatgaggaaatttgaggcccaaagacgaggggagaacttgtccaaggtctcagagctcagtggtggaccctggccagcacctgagtgtcctgctgcctctctccctggacccatgcatcgtctacctggggggatctgcatgggtcccaaatgaagggggcagagagagtcgggtcagctctcttgcccagtctaggggccgtgcctgagcgaggccctgcagggtagaggatgaggcagcttccctctccttttcagatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctccctttaaaaaaaaaaaaatccagaaagcagataaaagttggaatatggaaaagggcaagatgacccccaccagaggctctttggcctgaaggtggagtctctgcctccgtccgttctctatctctcctgtcacagactctgcctgaccccctttcctcagctcccttctggtcccccttcctcagctccctccgggcacttgtgcccttcccttccatgtcctcctgtatctcagccttcccccggggctgctggcccagcacacgagccctgcacccagcctgggtgggaggtccctggccagtcccccaggaactctgaggagctatgggctactgcaaagcatctgccgactgccctgccccgtctggcctcatcaggctgctgctgttagggatgggctcactcccagcagctcccggtcacccagcagggatggggagggtggccaccctggagctggaggactctggggaggcagggtctttaatttggcagcagacaaaagccagttctggagtcacaccacagtaggggctcacaggggctctgactccccagctggactggaagccctgctgtccgagggtgggcagcggtgggtcctggagtgacccctttgagcaggtgcagggctaaagagcaaggcggaaaggccgccagcctgggtgagcgcctagggcataagggcttgctgggtgcccctgagaagggcgggtgatctgaggaggagaactctgattctaggaacgcttacacggcactgaccactgccacggggagggaggctgcccagcccgtggccccgccctggacatgggagcgcgcagaccttccggagagccgggaagcctgggcaggcacgaggcttcggcgcggctctgggaggttgggagtggcatccgatccttggccgggccctggtggcctccgtggccccaagatcacaagggcgtagcgaaggcgagccggcgatcgcacctcgtcccgcccaccctgcccggactcgcaacgccgagcttggggagggccgggacgcgcagccgccgccgagcgtgaccaagtttggaaacgcgcgcggggccgggacgctggctcggggggccctgccgaggagcggtcgccccctccgctgctccccgcgccaggcctggggccctggagggaggggggggggtctccgaggagtgcctcggtaccccagctcgagttctcgacgggtctctgagccttccccgcgccaggacccggcgcactgtgggggaagccccagccccatgtctgttgagtgttgctttgttattttttttcctcctatgtgtgggttttttcttggagctgtttcataggaattcctgtaataaacagttggtgttc

SEQ ID NO: 420154 - DNA, 2005 bp, Homo sapiens
agaggatccccttgtctttgcgcattgtttgctgcgcgctgggcaccttgcggcatgcggcgaggtcgtcgtcactgtcctggtctggttctgtctttgtgaagcttgtagcgcgaccatcgtgggtccgtcccgtatttgtaatcttggtcgtcctgtttcctcgggtcagctctcttgcccagtctaggggccgtgcctgagcgaggccctgcagggtagaggatgaggcagcttccctctccttttcagatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctccctttaaaaaaaaaaaaatccagaaagcagataaaagttggaatatggaaaagggcaagatgacccccaccagaggctctttggcctgaaggtggagtctctgcctccgtccgttctctatctctcctgtcacagactctgcctgaccccctttcctcagctcccttctggtcccccttcctcagctccctccgggcacttgtgcccttcccttccatgtcctcctgtatctcagccttcccccggggctgctggcccagcacacgagccctgcacccagcctgggtgggaggtccctggccagtcccccaggaactctgaggagctatgggctactgcaaagcatctgccgactgccctgccccgtctggcctcatcaggctgctgctgttagggatgggctcactcccagcagctcccggtcacccagcagggatggggagggtggccaccctggagctggaggactctggggaggcagggtctttaatttggcagcagacaaaagccagttctggagtcacaccacagtaggggctcacaggggctctgactccccagctggactggaagccctgctgtccgagggtgggcagcggtgggtcctggagtgacccctttgagcaggtgcagggctaaagagcaaggcggaaaggccgccagcctgggtgagcgcctagggcataagggcttgctgggtgcccctgagaagggcgggtgatctgaggaggagaactctgattctaggaacgcttacacggcactgaccactgccacggggagggaggctgcccagcccgtggccccgccctggacatgggagcgcgcagaccttccggagagccgggaagcctgggcaggcacgaggcttcggcgcggctctgggaggttgggagtggcatccgatccttggccgggccctggtggcctccgtggccccaagatcacaagggcgtagcgaaggcgagccggcgatcgcacctcgtcccgcccaccctgcccggactcgcaacgccgagcttggggagggccgggacgcgcagccgccgccgagcgtgaccaagtttggaaacgcgcgcggggccgggacgctggctcggggggccctgccgaggagcggtcgccccctccgctgctccccgcgccaggcctggggccctggagggaggggggggggtctccgaggagtgcctcggtaccccagctcgagttctcgacgggtctctgagccttccccgcgccaggacccggcgcactgtgggggaagccccagccccatgtctgttgagtgttgctttgttattttttttcctcctatgtgtgggttttttcttggagctgtttcataggaattcctgtaataaacagttggtgttc

SEQ ID NO: 420155 - DNA, 2128 bp, Homo sapiens
gcccctgcaggctgacccaggatgtagcctcttgctcctggggtggcgtcctcaggggtctgcgattcctgtcatctctccctcctcagctcccacccttgcctgccccctgctccctctccggggggccttggtcctcccctggcctttcccacacctgggaggaggccatctggtgtgctggctgctgagagaatgactcacaggtctctctgcccccagccacccggaggaaactgtttgaacttgcccgagccttctcagagaagaccaaaatgaggaagtcaaagaggaaacacttgttgaagcatcagtcgctgggggctgccgcgtcaacagccaacctcctggatgatgtggagggccacgcgtgtgatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctccctttaaaaaaaaaaaaatccagaaagcagataaaagttggaatatggaaaagggcaagatgacccccaccagaggctctttggcctgaaggtggagtctctgcctccgtccgttctctatctctcctgtcacagactctgcctgaccccctttcctcagctcccttctggtcccccttcctcagctccctccgggcacttgtgcccttcccttccatgtcctcctgtatctcagccttcccccggggctgctggcccagcacacgagccctgcacccagcctgggtgggaggtccctggccagtcccccaggaactctgaggagctatgggctactgcaaagcatctgccgactgccctgccccgtctggcctcatcaggctgctgctgttagggatgggctcactcccagcagctcccggtcacccagcagggatggggagggtggccaccctggagctggaggactctggggaggcagggtctttaatttggcagcagacaaaagccagttctggagtcacaccacagtaggggctcacaggggctctgactccccagctggactggaagccctgctgtccgagggtgggcagcggtgggtcctggagtgacccctttgagcaggtgcagggctaaagagcaaggcggaaaggccgccagcctgggtgagcgcctagggcataagggcttgctgggtgcccctgagaagggcgggtgatctgaggaggagaactctgattctaggaacgcttacacggcactgaccactgccacggggagggaggctgcccagcccgtggccccgccctggacatgggagcgcgcagaccttccggagagccgggaagcctgggcaggcacgaggcttcggcgcggctctgggaggttgggagtggcatccgatccttggccgggccctggtggcctccgtggccccaagatcacaagggcgtagcgaaggcgagccggcgatcgcacctcgtcccgcccaccctgcccggactcgcaacgccgagcttggggagggccgggacgcgcagccgccgccgagcgtgaccaagtttggaaacgcgcgcggggccgggacgctggctcggggggccctgccgaggagcggtcgccccctccgctgctccccgcgccaggcctggggccctggagggaggggggggggtctccgaggagtgcctcggtaccccagctcgagttctcgacgggtctctgagccttccccgcgccaggacccggcgcactgtgggggaagccccagccccatgtctgttgagtgttgctttgttattttttttcctcctatgtgtgggttttttcttggagctgtttcataggaattcctgtaataaacagttggtgttc

SEQ ID NO: 420156 - DNA, 370 bp, Homo sapiens
cctccagagctttgaggggtggggcagagagtcagtgggactgggaggactagggcagtgtcccctcatccctgggacggttttcctgaatggcctggcaggcgctgggggctgccgcgtcaacagccaacctcctggatgatgtggagggccacgcgtgtggtgaggctggaggggagtcgtaagctccaacttctctatgatcggtgatctcccagcggagttcctgggtgtttcatgggagcacccgccctgtcccctggaggaacacactgagggttggtgggcaggtgacccaaagatatggatccccctgacttggtcgacattgcttccccctttctgcaacccctgaaaaggggccctagcc

SEQ ID NO: 420157 - DNA, 354 bp, Homo sapiens
gatgaagacttccggggcaggcgtcaggaggcacccaaggtggaggaaggcctgcgagaaggacagtaagaggtaaggcctggagccatagcaacccagggactgcccaaggccagggccccccacactatgcaccccacatgtcctcccaggtgtccagaggcgctgggctcaggcaactgggtagcacaggccccacgtgtcttccctcatagttgcggcagggacacgggcgtgggaactagttcattgcatgtcttttttggttatttattcatttgacaaaagatgagcacacctgcctatgacagatgctgagaacaggaaaacaaaatcagctttgaccttgaagag

SEQ ID NO: 420158 - DNA, 1946 bp, Homo sapiens
  misc_feature (1)..(1): n is a, c, g, or t
  misc_feature (4)..(4): n is a, c, g, or t
ngcncggccgcggcccggcccctgcggcccgcgcggagcggacgcgcgtggcgctgcccggtgggaccatccgtgaagccggtgccaggatgcaccgggggtgtggatgaccggccgcccagccccagcacggcccggtcccgcatgccaccgccccgcgaggaccgctctccaagggctgcctggggccccgcgcccgtactctcctaacccggagctctcggcagcccattgctgcctggctacccggggaggaggaggcgcaggagtgagctgcccgagaccgcagggcaagtaagcggctgacggcggaaagaccctggggaaggggctttgcggccggctagaaacattttccccaagcggctccgcaaaatgaccagcctgttccgccggagcagcagcggcagcggcgggggtggcaccgccggggcacgcgggggcgggggaggcacggccgccccccaggagctcaacaacagccggcctgcccgccaggtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccggccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagaggatcgcgcttttcctgcagaacgaggagttcatgaaggagctgcaacggaaccgcgacttcctcctcgctctggagagagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccaaaatgaggaagtcaaagaggaaacacttgttgaagcatcagtcgctgggggctgccgcgtcaacagccaacctcctggatgatgtggagggccacgcgtgtgatgaagacttccggggcaggcgtcaggaggcacccaaggtggaggaaggcctgcgagaaggacagtaagagatgccagcagctcttcctcgccgccttctgccatgtaagatatgactgtgctcctccttcaccttctgccatgattgtgaggcctccacagccatgtggaactggaagctgtttttccctctttggggtctcagagagattggtggcaaggactcctgggaagagaaaagctgaaggacactctggcaagaggaaaccccgagccaaacgtatggccacctctgaccactcgaccagcccagcatggtgtacatttctgggtagcttatcacgccttccaagcattgcctttatcttccttctccccatcaagcctgtattgttttccttttgaatcataagcacttttgttaaatacctcaaatctttcgagaacagcaaggagcaaaataaacttaacttctctg

SEQ ID NO: 420159 - DNA, 3565 bp, Homo sapiens
aagtgtggccacttcctcttgcctgtcctgactcaccctggctgctgcccattgtggctgccatggaaatacaactcgaggagaacccagaccaggacagggaggccatgttctgggtggcagtggagcctggcaaggtgccctcctggcctgggactgctgtggcagaggaagcatgaggtggggcctggcctgcccagctcagagctgaggtgcccccttggttttttacctccctgctccctggctggcccactgcacccacgcactcaacgcagtggcttcgctcctcctccaggatggctggaggtgggaccattgccaggatggcctcaagtgcccagccctcctggaagactcagtttccctctttgtcccatgcagaggtgcagagattcattattgtgggaccatccgtgaagccggtgccaggatgcaccgggggtgtggatgaccggccgcccagccccagcacggcccggtcccgcatgccaccgccccgcgaggaccgctctccaagggctgcctggggccccgcgcccgtactctcctaacccggagctctcggcagcccattgctgcctggctacccggggaggaggaggcgcaggagtgagctgcccgagaccgcagggcaagtaagcggctgacggcggaaagaccctggggaaggggctttgcggccggctagaaacattttccccaagcggctccgcaaaatgaccagcctgttccgccggagcagcagcggcagcggcgggggtggcaccgccggggcacgcgggggcgggggaggcacggccgccccccaggagctcaacaacagccggcctgcccgccaggtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccggccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagaggatcgcgcttttcctgcagaacgaggagttcatgaaggagctgcaacggaaccgcgacttcctcctcgctctggagagagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccaaaatgaggaagtcaaagaggaaacacttgttgaagcatcagtcgctgggggctgccgcgtcaacagccaacctcctggatgatgtggagggccacgcgtgtgatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctccctttaaaaaaaaaaaaatccagaaagcagataaaagttggaatatggaaaagggcaagatgacccccaccagaggctctttggcctgaaggtggagtctctgcctccgtccgttctctatctctcctgtcacagactctgcctgaccccctttcctcagctcccttctggtcccccttcctcagctccctccgggcacttgtgcccttcccttccatgtcctcctgtatctcagccttcccccggggctgctggcccagcacacgagccctgcacccagcctgggtgggaggtccctggccagtcccccaggaactctgaggagctatgggctactgcaaagcatctgccgactgccctgccccgtctggcctcatcaggctgctgctgttagggatgggctcactcccagcagctcccggtcacccagcagggatggggagggtggccaccctggagctggaggactctggggaggcagggtctttaatttggcagcagacaaaagccagttctggagtcacaccacagtaggggctcacaggggctctgactccccagctggactggaagccctgctgtccgagggtgggcagcggtgggtcctggagtgacccctttgagcaggtgcagggctaaagagcaaggcggaaaggccgccagcctgggtgagcgcctagggcataagggcttgctgggtgcccctgagaagggcgggtgatctgaggaggagaactctgattctaggaacgcttacacggcactgaccactgccacggggagggaggctgcccagcccgtggccccgccctggacatgggagcgcgcagaccttccggagagccgggaagcctgggcaggcacgaggcttcggcgcggctctgggaggttgggagtggcatccgatccttggccgggccctggtggcctccgtggccccaagatcacaagggcgtagcgaaggcgagccggcgatcgcacctcgtcccgcccaccctgcccggactcgcaacgccgagcttggggagggccgggacgcgcagccgccgccgagcgtgaccaagtttggaaacgcgcgcggggccgggacgctggctcggggggccctgccgaggagcggtcgccccctccgctgctccccgcgccaggcctggggccctggagggaggggggggggtctccgaggagtgcctcggtaccccagctcgagttctcgacgggtctctgagccttccccgcgccaggacccggcgcactgtgggggaagccccagccccatgtctgttgagtgttgctttgttattttttttcctcctatgtgtgggttttttcttggagctgtttcataggaattcctgtaataaacagttggtgttc

SEQ ID NO: 420160 - DNA, 4282 bp, Homo sapiens
  misc_feature (3567)..(3567): n is a, c, g, or t
aagtgtggccacttcctcttgcctgtcctgactcaccctggctgctgcccattgtggctgccatggaaatacaactcgaggagaacccagaccaggacagggaggccatgttctgggtggcagtggagcctggcaaggtgccctcctggcctgggactgctgtggcagaggaagcatgaggtggggcctggcctgcccagctcagagctgaggtgcccccttggttttttacctccctgctccctggctggcccactgcacccacgcactcaacgcagtggcttcgctcctcctccaggatggctggaggtgggaccattgccaggatggcctcaagtgcccagccctcctggaagactcagtttccctctttgtcccatgcagaggtgcagagattcattattgtgggaccatccgtgaagccggtgccaggatgcaccgggggtgtggatgaccggccgcccagccccagcacggcccggtcccgcatgccaccgccccgcgaggaccgctctccaagggctgcctggggccccgcgcccgtactctcctaacccggagctctcggcagcccattgctgcctggctacccggggaggaggaggcgcaggagtgagctgcccgagaccgcagggcaagtaagcggctgacggcggaaagaccctggggaaggggctttgcggccggctagaaacattttccccaagcggctccgcaaaatgaccagcctgttccgccggagcagcagcggcagcggcgggggtggcaccgccggggcacgcgggggcgggggaggcacggccgccccccaggagctcaacaacagccggcctgcccgccaggtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccggccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagaggatcgcgcttttcctgcagaacgaggagttcatgaaggagctgcaacggaaccgcgacttcctcctcgctctggagagagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccaaaatgaggaagtcaaagaggaaacacttgttgaagcatcagtcgctgggggctgccgcgtcaacagccaacctcctggatgatgtggagggccacgcgtgtgatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctccctttaaaaaaaaaaaaatccagaaagcagataaaagttggaatatggaaaagggcaagatgacccccaccagaggctctttggcctgaaggtggagtctctgcctccgtccgttctctatctctcctgtcacagactctgcctgaccccctttcctcagctcccttctggtcccccttcctcagctccctccgggcacttgtgcccttcccttccatgtcctcctgtatctcagccttcccccggggctgctggcccagcacacgagccctgcacccagcctgggtgggaggtccctggccagtcccccaggaactctgaggagctatgggctactgcaaagcatctgccgactgccctgccccgtctggcctcatcaggctgctgctgttagggatgggctcactcccagcagctcccggtcacccagcagggatggggagggtggccaccctggagctggaggactctggggaggcagggtctttaatttggcagcagacaaaagccagttctggagtcacaccacagtaggggctcacaggggctctgactccccagctggactggaagccctgctgtccgagggtgggcagcggtgggtcctggagtgacccctttgagcaggtgcagggctaaagagcaaggcggaaaggccgccagcctgggtgagcgcctagggcataagggcttgctgggtgcccctgagaagggcgggtgatctgaggaggagaactctgattctaggaacgcttacacggcactgaccactgccacggggagggaggctgcccagcccgtggccccgccctggacatgggagcgcgcagaccttccggagagccgggaagcctgggcaggcacgaggcttcggcgcggctctgggaggttgggagtggcatccgatccttggccgggccctggtggcctccgtggccccaagatcacaagggcgtagcgaaggcgagccggcgatcgcacctcgtcccgcccaccctgcccggactcgcaacgccgagcttggggagggccgggacgcgcagccgccgccgagcgtgaccaagtttggaaacgcgcgcggggccgggacgctggctcggggggccctgccgaggagcggtcgccccctccgctgctccccgcgccaggcctggggccctggagggaggggggggggtctccgaggagtgcctcggtaccccagctcgagttctcgacgggtctctgagccttccccgcgccaggacccggcgcactgtgggggaagccccagccccatgtctgttgagtgttgctttgttattttttttcctcctatgtgtgggttttttcttggagctgtttcataggaattcctgtaataaacagttggtgttcanaaaaaaaaaaaaaaaaaaaaaaaaaaaaaaaaaaaaaaaaaaaaaaaaaaagagagagggggtggcgcgcgccccaagagaagtctctcccgcgggagaggtgccccacgttcgcgcgcgcgccccccgcaggttttgtgtgtgtagaaaagagggggcgccccataatagaggaggagcgcggcgtatatatataacagaggcgagagggcggcggggcgcggcggtgattaacacaaagccgtggcgcggacgcgggggagaaaaagcggcgcgacaacgcggaggggcacaactctgtggggggagagagagagcgcccccatataaatcactgcgggggggggggggggagagcaacccatatgtggcggggcgcacacacacacctctctccatacagcgagagagaatatataacagacgcgccctctgagaggggggggaacacaactatctacacaccaatctttttagacgccggggatgtaatataagtggggggtggttgatacaccaacaatggcgggcgccgtgaaatatatagctgcgcggcgcaggcaggattaaagtagagaaagagttatttgtggcgcacagaactgcaggggaagattatatatatcatttatttagagaagagacatatttttttttacacccggagggcgggtttgtcttttgctattataaaacaacgacagaatgagaaatc

SEQ ID NO: 420161 - DNA, 2530 bp, Homo sapiens
aagtgtggccacttcctcttgcctgtcctgactcaccctggctgctgcccattgtggctgccatggaaatacaactcgaggagaacccagaccaggacagggaggccatgttctgggtggcagtggagcctggcaaggtgccctcctggcctgggactgctgtggcagaggaagcatgaggtggggcctggcctgcccagctcagagctgaggtgcccccttggttttttacctccctgctccctggctggcccactgcacccacgcactcaacgcagtggcttcgctcctcctccaggatggctggaggtgggaccattgccaggatggcctcaagtgcccagccctcctggaagactcagtttccctctttgtcccatgcagaggtgcagagattcattattgtgggaccatccgtgaagccggtgccaggatgcaccgggggtgtggatgaccggccgcccagccccagcacggcccggtcccgcatgccaccgccccgcgaggaccgctctccaagggctgcctggggccccgcgcccgtactctcctaacccggagctctcggcagcccattgctgcctggctacccggggaggaggaggcgcaggagtgagctgcccgagaccgcagggcaagtaagcggctgacggcggaaagaccctggggaaggggctttgcggccggctagaaacattttccccaagcggctccgcaaaatgaccagcctgttccgccggagcagcagcggcagcggcgggggtggcaccgccggggcacgcgggggcgggggaggcacggccgccccccaggagctcaacaacagccggcctgcccgccaggtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccggccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagaggatcgcgcttttcctgcagaacgaggagttcatgaaggagctgcaacggaaccgcgacttcctcctcgctctggagagagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccaaaatgaggaagtcaaagaggaaacacttgttgaagcatcagtcgctgggggctgccgcgtcaacagccaacctcctggatgatgtggagggccacgcgtgtgatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctccctttaaaaaaaaaaaaatccagaaagcagataaaagttggaatatggaaaagggcaagatgacccccaccagaggctctttggcctgaaggtggagtctctgcctccgtccgttctctatctctcctgtcacagactctgcctgaccccctttcctcagctcccaccctggagctggaggactctggggaggcagggtctttaatttggcagcagacaaaagccagttctggagtcaccccatgtctgttgagtgttgctttgttattttttttcctcctatgtgtgggttttttcttggagctgtttcataggaattcctgtaataaacagttggtgttc

SEQ ID NO: 420162 - DNA, 3293 bp, Homo sapiens
  misc_feature (1)..(1): n is a, c, g, or t
  misc_feature (4)..(4): n is a, c, g, or t
ngcncggccgcggcccggcccctgcggcccgcgcggagcggacgcgcgtggcgctgcccggtgggaccatccgtgaagccggtgccaggatgcaccgggggtgtggatgaccggccgcccagccccagcacggcccggtcccgcatgccaccgccccgcgaggaccgctctccaagggctgcctggggccccgcgcccgtactctcctaacccggagctctcggcagcccattgctgcctggctacccggggaggaggaggcgcaggagtgagctgcccgagaccgcagggcaagtaagcggctgacggcggaaagaccctggggaaggggctttgcggccggctagaaacattttccccaagcggctccgcaaaatgaccagcctgttccgccggagcagcagcggcagcggcgggggtggcaccgccggggcacgcgggggcgggggaggcacggccgccccccaggagctcaacaacagccggcctgcccgccaggtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccggccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagaggatcgcgcttttcctgcagaacgaggagttcatgaaggagctgcaacggaaccgcgacttcctcctcgctctggagagagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccaaaatgaggaagtcaaagaggaaacacttgttgaagcatcagtcgctgggggctgccgcgtcaacagccaacctcctggatgatgtggagggccacgcgtgtgatgaagacttccggggcaggcgtcaggaggcacccaaggtggaggaaggcctgcgagaaggacagtaagaggaaccagtgaccaggaaagaccattgggctcctttgaaaaagattcctcccatcccttttttcccctaccagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctccctttaaaaaaaaaaaaatccagaaagcagataaaagttggaatatggaaaagggcaagatgacccccaccagaggctctttggcctgaaggtggagtctctgcctccgtccgttctctatctctcctgtcacagactctgcctgaccccctttcctcagctcccttctggtcccccttcctcagctccctccgggcacttgtgcccttcccttccatgtcctcctgtatctcagccttcccccggggctgctggcccagcacacgagccctgcacccagcctgggtgggaggtccctggccagtcccccaggaactctgaggagctatgggctactgcaaagcatctgccgactgccctgccccgtctggcctcatcaggctgctgctgttagggatgggctcactcccagcagctcccggtcacccagcagggatggggagggtggccaccctggagctggaggactctggggaggcagggtctttaatttggcagcagacaaaagccagttctggagtcacaccacagtaggggctcacaggggctctgactccccagctggactggaagccctgctgtccgagggtgggcagcggtgggtcctggagtgacccctttgagcaggtgcagggctaaagagcaaggcggaaaggccgccagcctgggtgagcgcctagggcataagggcttgctgggtgcccctgagaagggcgggtgatctgaggaggagaactctgattctaggaacgcttacacggcactgaccactgccacggggagggaggctgcccagcccgtggccccgccctggacatgggagcgcgcagaccttccggagagccgggaagcctgggcaggcacgaggcttcggcgcggctctgggaggttgggagtggcatccgatccttggccgggccctggtggcctccgtggccccaagatcacaagggcgtagcgaaggcgagccggcgatcgcacctcgtcccgcccaccctgcccggactcgcaacgccgagcttggggagggccgggacgcgcagccgccgccgagcgtgaccaagtttggaaacgcgcgcggggccgggacgctggctcggggggccctgccgaggagcggtcgccccctccgctgctccccgcgccaggcctggggccctggagggaggggggggggtctccgaggagtgcctcggtaccccagctcgagttctcgacgggtctctgagccttccccgcgccaggacccggcgcactgtgggggaagccccagccccatgtctgttgagtgttgctttgttattttttttcctcctatgtgtgggttttttcttggagctgtttcataggaattcctgtaataaacagttggtgttc

SEQ ID NO: 420163 - DNA, 1313 bp, Homo sapiens
  misc_feature (1)..(1): n is a, c, g, or t
  misc_feature (4)..(4): n is a, c, g, or t
ngcncggccgcggcccggcccctgcggcccgcgcggagcggacgcgcgtggcgctgcccggtgggaccatccgtgaagccggtgccaggatgcaccgggggtgtggatgaccggccgcccagccccagcacggcccggtcccgcatgccaccgccccgcgaggaccgctctccaagggctgcctggggccccgcgcccgtactctcctaacccggagctctcggcagcccattgctgcctggctacccggggaggaggaggcgcaggagtgagctgcccgagaccgcagggcaagtaagcggctgacggcggaaagaccctggggaaggggctttgcggccggctagaaacattttccccaagcggctccgcaaaatgaccagcctgttccgccggagcagcagcggcagcggcgggggtggcaccgccggggcacgcgggggcgggggaggcacggccgccccccaggagctcaacaacagccggcctgcccgccaggtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccggccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagaggatcgcgcttttcctgcagaacgaggagttcatgaaggagctgcaacggaaccgcgacttcctcctcgctctggagagagatcgattgaaatacgaatcccagaaatctaaatccagcagcgtggctgtcggaaacgactttggcttttcctctcctgtcccaggtaactttgccttctggggaagaaaacctagaggcatagtggggagctcacacccaactttgctttgcat

SEQ ID NO: 420164 - DNA, 1628 bp, Homo sapiens
  misc_feature (1231)..(1231): n is a, c, g, or t
  misc_feature (1246)..(1246): n is a, c, g, or t
  misc_feature (1617)..(1617): n is a, c, g, or t
  misc_feature (1628)..(1628): n is a, c, g, or t
atcctgtgcgctgctgagctgagctggggcgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccaaaaccggtaaccccagacacctgcacgttctgattgggacctcagtggtcataactccctttcaccatcctcctcttctttctccttcatcgctggtgctccaacaaaaaaaatgcatgctgtaatggaccaagagcctgcagggaacagaacagtgaacagggaggattctgatgaacaagaccatcaggaggtgtcatacgcataattggatcactgtgttttcacacagagaaaaatcactcccccttctcagaggcccaagacacccccaacagataccagcatgtacatagaacttccaaatgctgagtccagatccaaagctgtcttctgtccacgagcaccacagtcaggccttgaggggatcttctagggagacaacagccctgtctcaaaaccgggttgccagctcccatgtaccagcagctggaatctgaaggcatcagtcttcatcttagggnatcgctcttcctcanaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacagcacttagacacgtgctgttccaccttccctcatgctgttccacctcccctcagactatctttcagccttctgtcagcagtaaaacttataaattgtttttagtaatttcaatgtagttttccctccttcaaataaacatgtctgcccncatggtttcgn

SEQ ID NO: 420165 - DNA, 1596 bp, Homo sapiens
atcctgtgcgctgctgagctgagctggggcgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactagcttacttcctagtctacctgaggctgcaatcacactgaggaactcacaattccaaacatacaagaggctccctcttaacacagcacttagacacgtgctgttccacctcccttcagactatctttcagccttctgccagcagtaaaacttataaattttttaaataatttcaatgtagttttcccgccttcaaataaacatgtctgccctca

SEQ ID NO: 420166 - DNA, 1810 bp, Homo sapiens
gagctggggcgcggctgcctgtctgcaccggcagcaccatgtcgctcatggtcgtcagcatggcgtgtgttgggttgttcttggtccagagggccggtccacacatgggtggtcaggacaagcccttcctgtctgcctggcccagcgctgtggtgcctcgcggaggacacgtgactcttcggtgtcactatcgtcataggtttaacaatttcatgctatacaaagaagacagaatccacgttcccatcttccatggcagaatattccaggagggcttcaacatgagccctgtgaccacagcacatgcagggaactacacatgtcggggttcacacccacactcccccactgggtggtcggcacccagcaaccccatggtgatcatggtcacaggaaaccacagaaaaccttccctcctggcccacccaggtcccctggtgaaatcaggagagagagtcatcctgcaatgttggtcagatatcatgtttgagcacttctttctgcacaaagagtggatctctaaggacccctcacgcctcgttggacagatccatgatggggtctccaaggccaatttctccatcggttccatgatgcgtgcccttgcagggacctacagatgctacggttctgttactcacaccccctatcagttgtcagctcccagtgatcccctggacatcgtggtcacaggtctatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactagcttacttcctagtctacctgaggctgcaatcacactgaggaactcacaattccaaacatacaagaggctccctcttaacacagcacttagacacgtgctgttccacctcccttcagactatctttcagccttctgccagcagtaaaacttataaattttttaaataatttcaatgtagttttcccgccttcaaataaacatgtctgccctca

SEQ ID NO: 420167 - DNA, 1296 bp, Homo sapiens
atcctgtgcgctgctgagctgagctggggcgcggccgcctgtctgcacagacagcaccatgtcgctcatggtcgtcagcatggcgtgtgttgggttcttcttgctgcagggggcctggccacatgagggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactagcttacttcctagtctacctgaggctgcaatcacactgaggaactcacaattccaaacatacaagaggctccctcttaacacagcacttagacacgtgctgttccacctcccttcagactatctttcagccttctgccagcagtaaaacttataaattttttaaataatttcaatgtagttttcccgccttcaaataaacatgtctgccctca

SEQ ID NO: 420168 - DNA, 957 bp, Homo sapiens
caccggcagcaccatgtcgctcatggtcgtcagcatggcgtgtgttgggttcttcttgctgcagggggcctggccacatgagggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactagcttacttcctagtctacctgaggctgcaatcacactgaggaactcacaattccaaacatacaagaggctccctcttaacacagcacttagacacgtgctgttccacctcccttcagactatctttcagccttctgccagcagtaaaacttataaattttttaaataatttcaatgtagttttcccgccttcaaataaacatgtctgccctca

SEQ ID NO: 420169 - DNA, 1743 bp, Homo sapiens
caccggcagcaccatgtcgctcatggtcgtcagcatggcgtgtgttgggttgttcttggtccagagggccggtccacacatgggtggtcaggacaagcccttcctgtctgcctggcccagcgctgtggtgcctcgcggaggacacgtgactcttcggtgtcactatcgtcataggtttaacaatttcatgctatacaaagaagacagaatccacgttcccatcttccatggcagaatattccaggagggcttcaacatgagccctgtgaccacagcacatgcagggaactacacatgtcggggttcacacccacactcccccactgggtggtcggcacccagcaaccccatggtgatcatggtcacaggaaaccacagaaaaccttccctcctggcccacccaggtcccctggtgaaatcaggagagagagtcatcctgcaatgttggtcagatatcatgtttgagcacttctttctgcacaaagagtggatctctaaggacccctcacgcctcgttggacagatccatgatggggtctccaaggccaatttctccatcggttccatgatgcgtgcccttgcagggacctacagatgctacggttctgttactcacaccccctatcagttgtcagctcccagtgatcccctggacatcgtggtcacaggtctatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaacctcagacacctgcacattctgattgggacctcagtggtcaaaatccctttcaccatcctcctcttctttctccttcatcgctggtgctccaacaaaaaaaaatgctgctgtaatggaccaagagcctgcagggaacagaagtgaacagcgaggattctgatgaacaagaccatcaggaggtgtcatacgcataattggaacactgtgttttcacacagagaaaaatcactcgcccttctcagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaactgggttgccagttcccatgtaccagcagctggaatctgaaggcatcagtcttcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccacacatacaagaggctccgtcttaacgcagcacttagacacgtgctgttccaccttccctcatgctg

SEQ ID NO: 420170 - DNA, 1500 bp, Homo sapiens
caccggcagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactagcttacttcctagtctacctgaggctgcaatcacactgaggaactcacaattccaaacatacaagaggctccctcttaacacagcacttagacacgtgctgttccacctcccttcagactatctttcagccttctgccagcagtaaaacttataaattttttaaataatttcaatgtagttttcccgccttcaaataaacatgtctgccctca

SEQ ID NO: 420171 - DNA, 1302 bp, Homo sapiens
atcctgtgcgctgctgagctgagctggggcgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactagcttacttcctagtctacctgaggctgcaatcacactgaggaactcacaattccaaacatacaagaggctccctcttaacacagcacttagacacgtgctgttccacctcccttcagactatctttcagccttctgccagcagtaaaacttataaattttttaaataatttcaatgtagttttcccgccttcaaataaacatgtctgccctca

SEQ ID NO: 420172 - DNA, 1063 bp, Homo sapiens
ttttgtagaaattattataatgtttccaaagtttaaattatcttacggttatttcaaggtgtcaataatatcacactgtcccagagtcagcaggtattctcacagtgactcatgaggccatttttagttttcccatttgtatgattggacactgcctggaatagtgtcctggaataagtgtcaggaatatcttccttttgttctggagttctcactgccatgaagggcagtattcatattgggaaatggagataacggaagatccagagaacacaaattggctttgagtcatgtgattaggcttcctgagaggttcagtgtcaccctgactatctccttagaagtgtggatgttgaaccagaacagtgctccagaaggagtgctcagtttcatagagcaatctgtgttttttagaaaaagaatccttttgctaatgtagtgaatattgggggcaagttgaaattttgcatttcctaacgtcttttatttatgcctagatgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacatatggtctgtgtagtttccgagatgtactatatacagtatatttttctaaaaaaaaatgccttgacccacccctatacctttttttaacgaaatctgtttctttcagctctgatggtagatacaagtagttactatttctgaatgggttttactgtaaagaattatgcaaattggccgggcgcggtggctcacgcctgtgatcccaacactttgggaggccgaggcgggcggatcacgaggtcaggagatcgagaccatcctggctggcacggtgaaaccc

SEQ ID NO: 420173 - DNA, 742 bp, Homo sapiens
ggaagtcgcgctgctgtggcggccgctgtagcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctgacagccgctcaggaagcaatcttgcatgcgtctggaaatggcacaaccaaggactactgcatgctttataacccttattggacagctcttccaagtaccctagaaaatgcaacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcaataacagtgtcctatttcctccctcaggtaacagatctgaatttcctgatgtgaaaatactgattgcatttataagctacaaagactttagagatatgaaccaggtaaattagcaattacatattagataaagtttataaatactgtatctctttatttttaatcactaatgtttaattttgagtgttatatttgctccatttgctaacaagaagctata

SEQ ID NO: 420174 - DNA, 713 bp, Homo sapiens
atttatctgccctcagaatatgatgccagtaagcccagtctgcaggtttgtcctcatgtagatcatttacattttcaccagagagaaaagagtcacagatttctctaactcttccactgtcagaggaacattgacatcacatcagagacccttttaagttaaaatgtttaattctgtctcccaggaaaggtcatgggagatatcctaatatgcctattgatttagattggaagaaaataagcaagagaaagtggggagtttttcagctcctcctgggctgggtcattacagtgtggcctcatcattctgtttaatgctttaggaattctaaggatgttagtaatgtccatcttttttttcacttagtcaagatttatttcaaggcttgaaaacattcaggccaactaaaatggtactactgtcactttttataatacataaataggccaggcacggtggctcacgcctgtaatcccaacactttgggaggccaaggcgggcagatcacctgaggtcaggagtttgagacaagcctggccaacatggtgaaaccctgtctctacgaaaaatacaaaaattacctgggtgcagtggtgcgtgcctgtaatcccagctacttgggaggctgaggcaggagaattgcttgaacctgggaggtggaggttgcagtgagctgagattgtgccattgcattccaacctaggtgacaagag

SEQ ID NO: 420175 - DNA, 325 bp, Homo sapiens
gcatataaatagctttattaaaatccttagttgttggcaagccataacattgcaagtttgaaagttattgtttgtctcctagacagccgctcaggaagcaatcttgcatgcgtctggaaatggcacaaccaaggactactgcatgctttataacccttattggacagctcttccaagtaccctagaaaatgcactgggtgcagtggtgcgtgcctgtaatcccagctacttgggaggctgaggcaggagaattgcttgaacctgggaggtggaggttgcagtgagctgagattgtgccattgcattccaacctaggtgacaagag

SEQ ID NO: 420176 - DNA, 2237 bp, Homo sapiens
ggcctggtactggtcggaattttgggatggcgctgtagcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctgacagccgctcaggaagcaatcttgcatgcgtctggaaatggcacaaccaaggactactgcatgctttataacccttattggacagctcttccaagtaccctagaaaatgcaacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcaataacagtgtcctatttcctccctcaggtaacagatctgaatttcctgatgtgaaaatactgattgcatttataagctacaaagactttagagatatgaaccagactctaggagataacattactgtgaaaatgtattctccatcgtggcctaactttgattatactatggtggttatttttgtaattgcggtgttcactgtggcattaggtggatactggagtggactagttgaattggaaaacttgaaagcagtgacaactgaagatagagaaatgaggaaaaagaaggaagaatatttaacttttagtcctcttacagttgtaatatttgtggtcatctgctgtgttatgatggtcttactttatttcttctacaaatggttggtttatgttatgatagcaattttctgcatagcatcagcaatgagtctgtacaactgtcttgctgcactaattcataagataccatatggacaatgcacgattgcatgtcgtggcaaaaacatggaagtgagacttatttttctctctggactgtgcatagcagtagctgttgtttgggctgtgtttcgaaatgaagacaggtgggcttggattttacaggatatcttggggattgctttctgtctgaatttaattaaaacactgaagttgcccaacttcaagtcatgtgtgatacttctaggccttctcctcctctatgatgtattttttgttttcataacaccattcatcacaaagaatggtgagagtatcatggttgaactcgcagctggaccttttggaaataatgaaaagttgccagtagtcatcagagtaccaaaactgatctatttctcagtaatgagtgtgtgcctcatgcctgtttcaatattgggttttggagacattattgtaccaggcctgttgattgcatactgtagaagatttgatgttcagactggttcttcttacatatactatgtttcgtctacagttgcctatgctattggcatgatacttacatttgttgttctggtgctgatgaaaaaggggcaacctgctctcctctatttagtaccttgcacacttattactgcctcagttgttgcctggagacgtaaggaaatgaaaaagttctggaaaggtaacagctatcagatgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacatatggtctgtgtagtttccgagatgtactatatacagtatatttttctaaaaaaaaatgccttgacccacccctatacctttttttaacgaaatctgtttctttcagctctgatggtagatacaagtagttactatttctgaatgggttttactgtaaagaattatgcaaattggccgggcgcggtggctcacgcctgtgatcccaacactttgggaggccgaggcgggcggatcacgaggtcaggagatcgagaccatcctggctggcacggtgaaaccc

SEQ ID NO: 420177 - DNA, 2291 bp, Homo sapiens
ggcctggtactggtcggaattttgggatggcgctgtagcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctgacagccgctcaggaagcaatcttgcatgcgtctggaaatggcacaaccaaggactactgcatgctttataacccttattggacagctcttccaagtaccctagaaaatgcaacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcaataacagtgtcctatttcctccctcaggtaacagatctgaatttcctgatgtgaaaatactgattgcatttataagctacaaagactttagagatatgaaccagactctaggagataacattactgtgaaaatgtattctccatcgtggcctaactttgattatactatggtggttatttttgtaattgcggtgttcactgtggcattaggtggatactggagtggactagttgaattggaaaacttgaaagcagtgacaactgaagatagagaaatgaggaaaaagaaggaagaatatttaacttttagtcctcttacagttgtaatatttgtggtcatctgctgtgttatgatggtcttactttatttcttctacaaatggttggtttatgttatgatagcaattttctgcatagcatcagcaatgagtctgtacaactgtcttgctgcactaattcataagataccatatggacaatgcacgattgcatgtcgtggcaaaaacatggaagtgagacttatttttctctctggactgtgcatagcagtagctgttgtttgggctgtgtttcgaaatgaagacaggtgggcttggattttacaggatatcttggggattgctttctgtctgaatttaattaaaacactgaagttgcccaacttcaagtcatgtgtgatacttctaggccttctcctcctctatgatgtattttttgttttcataacaccattcatcacaaagaatggtgagagtatcatggttgaactcgcagctggaccttttggaaataatgaaaagaatgatggaaacttggtggaagccactggtcaaccctcagctccccatgagaaattgccagtagtcatcagagtaccaaaactgatctatttctcagtaatgagtgtgtgcctcatgcctgtttcaatattgggttttggagacattattgtaccaggcctgttgattgcatactgtagaagatttgatgttcagactggttcttcttacatatactatgtttcgtctacagttgcctatgctattggcatgatacttacatttgttgttctggtgctgatgaaaaaggggcaacctgctctcctctatttagtaccttgcacacttattactgcctcagttgttgcctggagacgtaaggaaatgaaaaagttctggaaaggtaacagctatcagatgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacatatggtctgtgtagtttccgagatgtactatatacagtatatttttctaaaaaaaaatgccttgacccacccctatacctttttttaacgaaatctgtttctttcagctctgatggtagatacaagtagttactatttctgaatgggttttactgtaaagaattatgcaaattggccgggcgcggtggctcacgcctgtgatcccaacactttgggaggccgaggcgggcggatcacgaggtcaggagatcgagaccatcctggctggcacggtgaaaccc

SEQ ID NO: 420178 - DNA, 2010 bp, Homo sapiens
ggcctggtactggtcggaattttgggatggcgctgtagcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctgacagccgctcaggaagcaatcttgcatgcgtctggaaatggcacaaccaaggactactgcatgctttataacccttattggacagctcttccaagtaccctagaaaatgcaacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcaataacagtgtcctatttcctccctcaggtaacagatctgaatttcctgatgtgaaaatactgattgcatttataagctacaaagactttagagatatgaaccagactctaggagataacattactgtgaaaatgtattctccatcgtggcctaactttgattatactatggtggttatttttgtaattgcggtgttcactgtggcattaggtggatactggagtggactagttgaattggaaaacttgaaagcagtgacaactgaagatagagaaatgaggaaaaagaaggaagaatatttaacttttagtcctcttacagttgtaatatttgtggtcatctgctgtgttatgatggtcttactttatttcttctacaaatggttggtttatgttatgatagcaattttctgcatagcatcagcaatgagtctgtacaactgtcttgctgcactaattcataagataccatatggacaatgcacgattgcatgtcgtggcaaaaacatggaagtgagacttatttttctctctggactgtgcatagcagtagctgttgtttgggctgtgtttcgaaatgaagacaggtgggcttggattttacaggatatcttggggattgctttctgtctgaatttaattaaaacactgaagttgcccaacttcaagtcatgtgtgatacttctaggccttctcctcctctatgatgtattttttgttttcataacaccattcatcacaaagaatggtgagagtatcatggttgaactcgcagctggaccttttggaaataatgaaaagttgccagtagtcatcagagtaccaaaactgatctatttctcagtaatgagtgtgtgcctcatgcctgtttcaatattgggttttggagacattattgtaccaggcctgttgattgcatactgtagaagatttgatgttcagactggttcttcttacatatactatgtttcgtctacagttgcctatgctattggcatgatacttacatttgttgttctggtgctgatgaaaaaggggcaacctgctctcctctatttagtaccttgcacacttattactgcctcagttgttgcctggagacgtaaggaaatgaaaaagttctggaaaggtaacagctatcagatgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacagtgatgcgacaagcccttttttttctctattgtgattatcatataccacctgaa

SEQ ID NO: 420179 - DNA, 2076 bp, Homo sapiens
ggcctggtactggtcggaattttgggatggcgctgtagcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctgacagccgctcaggaagcaatcttgcatgcgtctggaaatggcacaaccaaggactactgcatgctttataacccttattggacagctcttccaagtaccctagaaaatgcaacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcaataacagtgtcctatttcctccctcaggtaacagatctgaatttcctgatgtgaaaatactgattgcatttataagctacaaagactttagagatatgaaccagactctaggagataacattactgtgaaaatgtattctccatcgtggcctaactttgattatactatggtggttatttttgtaattgcggtgttcactgtggcattaggtggatactggagtggactagttgaattggaaaacttgaaagcagtgacaactgaagatagagaaatgaggaaaaagaaggaagaatatttaacttttagtcctcttacagttgtaatatttgtggtcatctgctgtgttatgatggtcttactttatttcttctacaaatggttggtttatgttatgatagcaattttctgcatagcatcagcaatgagtctgtacaactgtcttgctgcactaattcataagataccatatggacaatgcacgattgcatgtcgtggcaaaaacatggaagtgagacttatttttctctctggactgtgcatagcagtagctgttgtttgggctgtgtttcgaaatgaagacaggtgggcttggattttacaggatatcttggggattgctttctgtctgaatttaattaaaacactgaagttgcccaacttcaagtcatgtgtgatacttctaggccttctcctcctctatgatgtattttttgttttcataacaccattcatcacaaagaatggtgagagtatcatggttgaactcgcagctggaccttttggaaataatgaaaagttgccagtagtcatcagagtaccaaaactgatctatttctcagtaatgagtgtgtgcctcatgcctgtttcaatattgggttttggagacattattgtaccaggcctgttgattgcatactgtagaagatttgatgttcagactggttcttcttacatatactatgtttcgtctacagttgatgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacatatggtctgtgtagtttccgagatgtactatatacagtatatttttctaaaaaaaaatgccttgacccacccctatacctttttttaacgaaatctgtttctttcagctctgatggtagatacaagtagttactatttctgaatgggttttactgtaaagaattatgcaaattggccgggcgcggtggctcacgcctgtgatcccaacactttgggaggccgaggcgggcggatcacgaggtcaggagatcgagaccatcctggctggcacggtgaaaccc

SEQ ID NO: 420180 - DNA, 996 bp, Homo sapiens
tatgagtaaagattgccaagaagttcattggcggcctctgttttgttttttgttttgttttgttttgttttgttttgtttttgaacagttgccagtagtcatcagagtaccaaaactgatctatttctcagtaatgagtgtgtgcctcatgcctgtttcaatattgggttttggagacattattgtaccaggcctgttgattgcatactgtagaagatttgatgttcagactggttcttcttacatatactatgtttcgtctacagttgcctatgctattggcatgatacttacatttgttgttctggtgctgatgaaaaaggggcaacctgctctcctctatttagtaccttgcacacttattactgcctcagttgttgcctggagacgtaaggaaatgaaaaagttctggaaaggtaacagctatcagatgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacatatggtctgtgtagtttccgagatgtactatatacagtatatttttctaaaaaaaaatgccttgacccacccctatacctttttttaacgaaatctgtttctttcagctctgatggtagatacaagtagttactatttctgaatgggttttactgtaaagaattatgcaaattggccgggcgcggtggctcacgcctgtgatcccaacactttgggaggccgaggcgggcggatcacgaggtcaggagatcgagaccatcctggctggcacggtgaaaccc

SEQ ID NO: 420181 - DNA, 1652 bp, Homo sapiens
ggcctggtactggtcggaattttgggatggcgctgtagcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctgacagccgctcaggaagcaatcttgcatgcgtctggaaatggcacaaccaaggactactgcatgctttataacccttattggacagctcttccaagtaccctagaaaatgcaacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcaataacagtgtcctatttcctccctcaggtaacagatctgaatttcctgatgtgaaaatactgattgcatttataagctacaaagactttagagatatgaaccagactctaggagataacattactgtgaaaatgtattctccatcgtggcctaactttgattatactatggtggttatttttgtaattgcggtgttcactgtggcattaggtggatactggagtggactagttgaattggaaaacttgaaagcagtgacaactgaagatagagaaatgaggaaaaagaaggaagaatatttaacttttagtcctcttacagttgtaatatttgtggtcatctgctgtgttatgatggtcttactttatttcttctacaaatggttggtttatgttatgatagcaattttctgcatagcatcagcaatgagtctgtacaactgtcttgctgcactaattcataagataccatatggacaatgcacgattgcatgtcgtggcaaaaacatggaagtgagacttatttttctctctggactgtgcatagcagtagctgttgtttgggctgtgtttcgaaatgaagacagtcatgtgtgatacttctaggccttctcctcctctatgatgtattttttgttttcataacaccattcatcacaaagaatggtgagagtatcatggttgaactcgcagctggaccttttggaaataatgaaaaggtagggatggcaatgaaatagaaatggctatccagtgtatgtatgtgtatccggttaataatttgccttcctgtgtaattcactggccacatagtgcatgttaaggtattgtaaaacttatttctcagaaaatatagctcttttcttagttattctaaattattaaatacctattgacttgggtttcatcctagaatgatggaaacttggtggaagccactggtcaaccctcagctccccatgagaaagtaaggattgtattttagatatgttcattggactttaaatcataccctctgagacaagactcttctttgggggaaaaaaaaatccagattgccaaaaaaaattaggcctgttctgttttctatgtttcaaggcctgagttctatccttggtaaagag

SEQ ID NO: 420182 - DNA, 2088 bp, Homo sapiens
ggcctggtactggtcggaattttgggatggcgctgtagcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctgacagccgctcaggaagcaatcttgcatgcgtctggaaatggcacaaccaaggactactgcatgctttataacccttattggacagctcttccaagtaccctagaaaatgcaacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcaataacagtgtcctatttcctccctcaggtaacagatctgaatttcctgatgtgaaaatactgattgcatttataagctacaaagactttagagatatgaaccagactctaggagataacattactgtgaaaatgtattctccatcgtggcctaactttgattatactatggtggttatttttgtaattgcggtgttcactgtggcattaggtggatactggagtggactagttgaatttttatgttatgatagcaattttctgcatagcatcagcaatgagtctgtacaactgtcttgctgcactaattcataagataccatatggacaatgcacgattgcatgtcgtggcaaaaacatggaagtgagacttatttttctctctggactgtgcatagcagtagctgttgtttgggctgtgtttcgaaatgaagacaggtgggcttggattttacaggatatcttggggattgctttctgtctgaatttaattaaaacactgaagttgcccaacttcaagtcatgtgtgatacttctaggccttctcctcctctatgatgtattttttgttttcataacaccattcatcacaaagaatggtgagagtatcatggttgaactcgcagctggaccttttggaaataatgaaaagttgccagtagtcatcagagtaccaaaactgatctatttctcagtaatgagtgtgtgcctcatgcctgtttcaatattgggttttggagacattattgtaccaggcctgttgattgcatactgtagaagatttgatgttcagactggttcttcttacatatactatgtttcgtctacagttgcctatgctattggcatgatacttacatttgttgttctggtgctgatgaaaaaggggcaacctgctctcctctatttagtaccttgcacacttattactgcctcagttgttgcctggagacgtaaggaaatgaaaaagttctggaaaggtaacagctatcagatgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacatatggtctgtgtagtttccgagatgtactatatacagtatatttttctaaaaaaaaatgccttgacccacccctatacctttttttaacgaaatctgtttctttcagctctgatggtagatacaagtagttactatttctgaatgggttttactgtaaagaattatgcaaattggccgggcgcggtggctcacgcctgtgatcccaacactttgggaggccgaggcgggcggatcacgaggtcaggagatcgagaccatcctggctggcacggtgaaaccc

SEQ ID NO: 420183 - DNA, 2003 bp, Homo sapiens
ggcctggtactggtcggaattttgggatggcgctgtagcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctgacagccgctcaggaagcaatcttgcatgcgtctggaaatggcacaaccaaggactactgcatgctttataacccttattggacagctcttccaagtaccctagaaaatgcaacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcaataacagtgtcctatttcctccctcaggtaacagatctgaatttcctgatgtgaaaatactgattgcatttataagctacaaagactttagagatatgaaccagactctaggagataacattactgtgaaaatgtattctccatcgtggcctaactttgattatactatggtggttatttttgtaattgcggtgttcactgtggcattaggtggatactggagtggactagttgaattggaaaacttgaaagcagtgacaactgaagatagagaaatgaggaaaaagaaggaagaatatttaacttttagtcctcttacagttgtaatatttgtggtcatctgctgtgttatgatggtcttactttatttcttctacaaatggttggtttatgttatgatagcaattttctgcatagcatcagcaatgagtctgtacaactgtcttgctgcactaattcataagataccatatggacaatgcacgattgcatgtcgtggcaaaaacatggaagtgagacttatttttctctctggactgtgcatagcagtagctgttgtttgggctgtgtttcgaaatgaagacaggtgggcttggattttacaggatatcttggggattgctttctgtctgaatttaattaaaacactgaagttgcccaacttcaagtcatgtgtgatacttctaggccttctcctcctctatgatgtattttttgttttcataacaccattcatcacaaagaatggtgagagtatcatggttgaactcgcagctggaccttttggaaataatgaaaagttgccagtagtcatcagagtaccaaaactgatctatttctcagtaatgagtgtgtgcctcatgcctgtttcaatattgggttttggagacattattgtaccaggcctgttgattgcatactgtagaagatttgatgttcagactggttcttcttacatatactatgtttcgtctacagttgcctatgctattggcatgatacttacatttgttgttctggtgctgatgaaaaaggggcaacctgctctcctctatttagtaccttgcacacttattactgcctcagttgttgcctggagacgtaaggaaatgaaaaagttctggaaaggtaacagctatcagatgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacagatcggcctggatttatatcataatattccctcgcgtccgtccggca

SEQ ID NO: 420184 - DNA, 2057 bp, Homo sapiens
ggcctggtactggtcggaattttgggatggcgctgtagcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctgacagccgctcaggaagcaatcttgcatgcgtctggaaatggcacaaccaaggactactgcatgctttataacccttattggacagctcttccaagtaccctagaaaatgcaacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcaataacagtgtcctatttcctccctcaggtaacagatctgaatttcctgatgtgaaaatactgattgcatttataagctacaaagactttagagatatgaaccagactctaggagataacattactgtgaaaatgtattctccatcgtggcctaactttgattatactatggtggttatttttgtaattgcggtgttcactgtggcattaggtggatactggagtggactagttgaattggaaaacttgaaagcagtgacaactgaagatagagaaatgaggaaaaagaaggaagaatatttaacttttagtcctcttacagttgtaatatttgtggtcatctgctgtgttatgatggtcttactttatttcttctacaaatggttggtttatgttatgatagcaattttctgcatagcatcagcaatgagtctgtacaactgtcttgctgcactaattcataagataccatatggacaatgcacgattgcatgtcgtggcaaaaacatggaagtgagacttatttttctctctggactgtgcatagcagtagctgttgtttgggctgtgtttcgaaatgaagacaggtgggcttggattttacaggatatcttggggattgctttctgtctgaatttaattaaaacactgaagttgcccaacttcaagtcatgtgtgatacttctaggccttctcctcctctatgatgtattttttgttttcataacaccattcatcacaaagaatggtgagagtatcatggttgaactcgcagctggaccttttggaaataatgaaaagaatgatggaaacttggtggaagccactggtcaaccctcagctccccatgagaaattgccagtagtcatcagagtaccaaaactgatctatttctcagtaatgagtgtgtgcctcatgcctgtttcaatattgggttttggagacattattgtaccaggcctgttgattgcatactgtagaagatttgatgttcagactggttcttcttacatatactatgtttcgtctacagttgcctatgctattggcatgatacttacatttgttgttctggtgctgatgaaaaaggggcaacctgctctcctctatttagtaccttgcacacttattactgcctcagttgttgcctggagacgtaaggaaatgaaaaagttctggaaaggtaacagctatcagatgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacagatcggcctggatttatatcataatattccctcgcgtccgtccggca

SEQ ID NO: 420185 - DNA, 1849 bp, Homo sapiens
ggcctggtactggtcggaattttgggatggcgctgtagcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctgacagccgctcaggaagcaatcttgcatgcgtctggaaatggcacaaccaaggactactgcatgctttataacccttattggacagctcttccaagtaccctagaaaatgcaacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcaataacagtgtcctatttcctccctcaggtaacagatctgaatttcctgatgtgaaaatactgattgcatttataagctacaaagactttagagatatgaaccagactctaggagataacattactgtgaaaatgtattctccatcgtggcctaactttgattatactatggtggttatttttgtaattgcggtgttcactgtggcattaggtggatactggagtggactagttgaattggaaaacttgaaagcagtgacaactgaagatagagaaatgaggaaaaagaaggaagaatatttaacttttagtcctcttacagttgtaatatttgtggtcatctgctgtgttatgatggtcttactttatttcttctacaaatggttggtttatgttatgatagcaattttctgcatagcatcagcaatgagtctgtacaactgtcttgctgcactaattcataagataccatatggacaatgcacgattgcatgtcgtggcaaaaacatggaagtgagacttatttttctctctggactgtgcatagcagtagctgttgtttgggctgtgtttcgaaatgaagacaggtgggcttggattttacaggatatcttggggattgctttctgtctgaatttaattaaaacactgaagttgcccaacttcaagtcatgtgtgatacttctaggccttctcctcctctatgatgtattttttgttttcataacaccattcatcacaaagaatggtgagagtatcatggttgaactcgcagctggaccttttggaaataatgaaaagttgccagtagtcatcagagtaccaaaactgatctatttctcagtaatgagtgtgtgcctcatgcctgtttcaatattgggttttggagacattattgtaccaggcctgttgattgcatactgtagaagatttgatgttcagactggttcttcttacatatactatgtttcgtctacagttgatgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacagatgcggccaggtctggtacgttaaattatacttcgacagcgtactagcgaaca

SEQ ID NO: 420186 - DNA, 1072 bp, Homo sapiens
ggcctggtactggtcggaattttgggatggcgctgtagcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctgacagccgctcaggaagcaatcttgcatgcgtctggaaatggcacaaccaaggactactgcatgctttataacccttattggacagctcttccaagtaccctagaaaatgcaacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcaataacagtgtcctatttcctccctcaggtaacagatctgaatttcctgatgtgaaaatactgattgcatttataagctacaaagactttagagatatgaaccagactctaggagataacattactgtgaaaatgtattctccatcgtggcctaactttgattatactatggtggttatttttgtaattgcggtgttcactgtggcattaggtggatactggagtggactagttgaattgaaaccttgcaagcagtgacgagctgaagatagagaactggtggaataaaaggaaggactttttaaacttttactcctttaccaggctgcactttgcggactcgggtagggcatgatggccttactcaatctctactcaaacagaaggtccatgtatgatgcaacttactgcaaacatcacaatcaagctggccatctgccttcgtgcactaactacacaaaacccaaggcccatgcacgtagctcgtctgagaaaacaggacaccgcctgattctatcattgcacggtacacgcagaagggcag

SEQ ID NO: 420187 - DNA, 1513 bp, Homo sapiens
attcacttctcacaaggactgggtgaagagttctgcagccttacagagactggaaaagaagcccaaaccaaggcccccagagaggtcccccaggcccctttgggtccctgagcctcagctggaggtggggggtgcctgcagtgcgctggctcagtctccttctgaaaagctggatccagcttgtttgaagcccttgagctgatcttagatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataacaaaaaaaaaaa

SEQ ID NO: 420188 - DNA, 682 bp, Homo sapiens
caattgctggccgttcactcctggatcctcactaaccagatccaggcagcgtcccgggagccacgtcttcttgtggtactgacccccagggctgaccaccagcctctcacggaggcatcttatgttaacctacctaccattgcgctgtgtaacacagattctcctctgcgctatgtggacattgccatcccatgcaacaacaagggagctcactcagtgggtttaatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttccactgctactcagcctgaggtcgcagactggtctgaagctgcccgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataacaaaaaaaaaaa

SEQ ID NO: 420189 - DNA, 2039 bp, Homo sapiens
ttcaagttctggggagaccgcagggggccccccagctggctccccaggccttggctctaactcccaccctcctcccagccccaggagaacacgattctccatgctcattggccagtttcccctaaaccctccctccgagcacccgggcgccagtcccaggcggaggggacgggctggggaccccaaagctgggaccggagggtgagcccggcagaggcagagacacacgcggagaggaggagaggctgagggagggaggtggagaaggacgggagaggcagagagaggagacacgcagagacactcaggaggggagagacaccgagacgcagagacactcaggaggggagagacaccgagacgcagagacacccaggccggggagcgcgagggagcgaggcacagacctggctcagcgagcgcggggggcgagccccgagtcccgagagcctgggggcgcgcccagcccgggcgccgaccctcctcccgctcccgcgccctcccctcggcgggcacggtatttttatccgtgcgcgaacagccctcctcctcctctcgccgcacagcccgccgcctgcgcgggggagcccagcacagaccgccgccgggaccccgagtcgcgcaccccagccccaccggccaccccgcgcgccatggaccccaaggaccgcaagaagatccagttctcggtgcccgcgccccctagccagctcgacccccgccaggtggagatgatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataacaaaaaaaaaaa

SEQ ID NO: 420190 - DNA, 1645 bp, Homo sapiens
tgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagcccgccgcctgcgcgggggagcccagcacagaccgccgccgggaccccgagtcgcgcaccccagccccaccggccaccccgcgcgccatggaccccaaggaccgcaagaagatccagttctcggtgcccgcgccccctagccagctcgacccccgccaggtggagatgatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataacaaaaaaaaaaa

SEQ ID NO: 420191 - DNA, 1674 bp, Homo sapiens
ttcaagttctggggagaccgcagggggccccccagctggctccccaggccttggctctaactcccaccctcctcccagccccaggagaacacgattctccatgctcattggccagtttcccctaaaccctccctccgagcacccgggcgccagtcccaggcggaggggacgggctggggaccccaaagctgggaccggaggcccgccgcctgcgcgggggagcccagcacagaccgccgccgggaccccgagtcgcgcaccccagccccaccggccaccccgcgcgccatggaccccaaggaccgcaagaagatccagttctcggtgcccgcgccccctagccagctcgacccccgccaggtggagatgatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataacaaaaaaaaaaa

SEQ ID NO: 420192 - DNA, 1890 bp, Homo sapiens
ttcaagttctggggagaccgcagggggccccccagctggctccccaggccttggctctaactcccaccctcctcccagccccaggagaacacgattctccatgctcattggccagtttcccctaaaccctccctccgagcacccgggcgccagtcccaggcggaggggacgggctggggaccccaaagctgggaccggagggtgagcccggcagaggcagagacacacgcggagaggaggagaggctgagggagggaggtggagaaggacgggagaggcagagagaggagacacgcagagacactcaggaggggagagacaccgagacgcagagacactcaggaggggagagacaccgagacgcagagacacccaggccggggagcgcgagggagcgaggcacagacctggctcagcgagcgcggggggcgagccccgagtcccgagagcctgggggcgcgcccagcccgggcgccgaccctcctcccgctcccgcgccctcccctcggcgggcacggtatttttatccgtgcgcgaacagccctcctcctcctctcgccgcacagcccgccgcctgcgcgggggagcccagcacagaccgccgccgggaccccgagtcgcgcaccccagccccaccggccaccccgcgcgccatggaccccaagccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataacaaaaaaaaaaa

SEQ ID NO: 420193 - DNA, 1477 bp, Homo sapiens
tgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataacaaaaaaaaaaa

SEQ ID NO: 420194 - DNA, 1429 bp, Homo sapiens
attcacttctcacaaggactgggtgaagagttctgcagccttacagagactggaaaagaagcccaaaccaaggcccccagagaggtcccccaggcccctttgggtccctgagcctcagctggagatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataacaaaaaaaaaaa

SEQ ID NO: 420195 - DNA, 1210 bp, Homo sapiens
tactccacaaacagcctcgcgtatagagaccaacccctgtgcctacaccaaaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataacaaaaaaaaaaa

SEQ ID NO: 420196 - DNA, 913 bp, Homo sapiens
gatctgtgattaaagcagtaatattttaagatgagctgggaaaaacatcaactcctgaagttagaaataagaatggtttgtaaatccacagctatatcctgatgctggatggtattaatcttgtgtagtcttcaactggttagtgtgaaatagttctgccaccactcccgtaccaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataacaaaaaaaaaaa

SEQ ID NO: 420197 - DNA, 1914 bp, Homo sapiens
ttcaagttctggggagaccgcagggggccccccagctggctccccaggccttggctctaactcccaccctcctcccagccccaggagaacacgattctccatgctcattggccagtttcccctaaaccctccctccgagcacccgggcgccagtcccaggcggaggggacgggctggggaccccaaagctgggaccggagggtgagcccggcagaggcagagacacacgcggagaggaggagaggctgagggagggaggtggagaaggacgggagaggcagagagaggagacacgcagagacactcaggaggggagagacaccgagacgcagagacactcaggaggggagagacaccgagacgcagagacacccaggccggggagcgcgagggagcgaggcacagacctggctcagcgagcgcggggggcgagccccgagtcccgagagcctgggggcgcgcccagcccgggcgccgaccctcctcccgctcccgcgccctcccctcggcgggcacggtatttttatccgtgcgcgaacagccctcctcctcctctcgccgcacagcccgccgcctgcgcgggggagcccagcacagaccgccgccgggaccccgagtcgcgcaccccagccccaccggccaccccgcgcgccatggaccccaaggaccgcaagaagatccagttctcggtgcccgcgccccctagccagctcgacccccgccaggtggagatgatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctccagggttgccccatgtgacaagatacagactgtgtccctaaagtaaaggcgcaggttcagc

SEQ ID NO: 420198 - DNA, 1675 bp, Homo sapiens
ttcaagttctggggagaccgcagggggccccccagctggctccccaggccttggctctaactcccaccctcctcccagccccaggagaacacgattctccatgctcattggccagtttcccctaaaccctccctccgagcacccgggcgccagtcccaggcggaggggacgggctggggaccccaaagctgggaccggagggtgagcccggcagaggcagagacacacgcggagaggaggagaggctgagggagggaggtggagaaggacgggagaggcagagagaggagacacgcagagacactcaggaggggagagacaccgagacgcagagacactcaggaggggagagacaccgagacgcagagacacccaggccggggagcgcgagggagcgaggcacagacctggctcagcgagcgcggggggcgagccccgagtcccgagagcctgggggcgcgcccagcccgggcgccgaccctcctcccgctcccgcgccctcccctcggcgggcacggtatttttatccgtgcgcgaacagccctcctcctcctctcgccgcacagcccgccgcctgcgcgggggagcccagcacagaccgccgccgggaccccgagtcgcgcaccccagccccaccggccaccccgcgcgccatggaccccaaggaccgcaagaagatccagttctcggtgcccgcgccccctagccagctcgacccccgccaggtggagatgatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcttagggtcctgccctgtgggtctcctgtgtccaggggagaggatctggggagtagaattgtaagggcatatccctgggg

SEQ ID NO: 420199 - DNA, 293 bp, Homo sapiens
cggaggcgttgaatggcccggaggcgttgaatggcccggaggcgttgaatggcccggaggcgttgaatggcccacgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataacaaaaaaaaaaa

SEQ ID NO: 420200 - DNA, 3955 bp, Homo sapiens
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccaggagctgggggttggtgagacaagtgggccagagacccagggtgaagattactcctcgtcttccttggagccacaccctgcagaccctggaatggagacaggagaagccctcagcttcggagcaagccctggcaggtgcccggcccgccccccaccctccggctcccagggcctgctggaggagatgctggcagccagcagctccaaggcggtggctcggagggagtcagcggcctcgggccttgggggcctgttggaggaggaaggagccggggcaggtgctgcccaagaggaggtgctggagcctggcagggactctccaccctcctggaggccgcagcctgatggtgaggccagccagacagaagacgtggatggcacctggggctcttcagcagccaggtggagcgatcaggggccagcacagacttctcggcgaccctcccaaggccctcctgccagatcccccagtcaggacttctccttcattgaggacaccgagatcctcgacagtgccatgtatcggagccgtgccaacttggggcgcaagcgtgggcaccgggccccggtcattcggcctgggggtaccttgggcctgtcggaggcagcagactcggatgcacacctgttccaggactctacagagccacgggcatctcgggtgccatcttcagatgaagaggtagtggaggaacctcagagccgccggacacggatgtcgttgggcaccaaggggctgaaagtcaacctctttcctggcctgagcccctcagccctgaaggccaagctgcgcccccggaatcgctcagctgaggagggagagctggctgagagcaagtcgagccagaaggagtccgcggtccagcgttcgaaatcctgcaaggtcccaggactgggaaagcccctcacgttacctcccaagccagagaaatcctcagggtcagaaggatcgtcgcccaactggcttcaagccctgaaactgaagaagaagaaggtctgagaagtcactgaggttcttcccacctggcagtctcaggcagtgcccattcctgtggggtccctgggtgaggagacggctggagccccaccatgccccaggctgcagcctctgtcccctccacctctgaggagcgtctggggaggcacatttatgcactttgtatcaccctccgaactccccccacaccttcccttccctggatttcatcactagtggttgaaggttttgtcccttcctctcctccttccctctccctctctgcttcctcctccagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttgggaa

SEQ ID NO: 420201 - DNA, 530 bp, Homo sapiens
ggtacctgagactagaggagaactttaactccttatgggttaaaggaaagaggagttatctttttaggagctgttgagaggtctgggcatccaggatgcttttcctaaagtagctggggaatttaacccttcatgctcaggtagggaataagcactgttttctggggcacttgccgaatggaaaatggacagattctgtgtccctaatagttgcaggcagggctcaagagtaaatggctaggagggtttaacctttgggtgctgttaaagttgcactgggagactctcccacattttccattctgtgacagactctaacattccgtgcttccatttcctgtcctcgtccctcacaggagccttccttccgacctggccttcaacggggacctggctaaggcagccagctcggagctacctgctgatgtgagttatcctccagttatgaatcagaatcacgtattttagagctggaagggtcatatgagatcatcttttctactccttgtagttcagatggggaaactgag

SEQ ID NO: 420202 - DNA, 406 bp, Homo sapiens
accgatcttcgtcccatcagctatgtgaaggggtgtgtatggagtgatcctgccgccccctccctgggctggtccagagatctcaaactccgatgcccctggggccacgtatgttgtgtaaatggatgaaacaggcccttgagttgggagcctgcttcactttgactttcccactgttgctggagacaaagacatcctgagggagcaagactgcgcagtcttctcccatcaggagccttccttccgacctggccttcaacggggacctggctaaggcagccagctcggagctacctgctgatgtgagttatcctccagttatgaatcagaatcacgtattttagagctggaagggtcatatgagatcatcttttctactccttgtagttcagatggggaaactgag

SEQ ID NO: 420203 - DNA, 2629 bp, Homo sapiens
gatcaaagcattaatcaattgagttgcttgtcttgttgattcagtgccaccccttatagtgattatccagtttctcatccttgtgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccaggagctgggggttggtgagacaagtgggccagagacccagggtgaagattactcctcgtcttccttggagccacaccctgcagaccctggaatggagacaggagaagccctcagcttcggagcaagccctggcaggtgcccggcccgccccccaccctccggctcccagggcctgctggaggagatgctggcagccagcagctccaaggcggtggctcggagggagtcagcggcctcgggccttgggggcctgttggaggaggaaggagccggggcaggtgctgcccaagaggaggtgctggagcctggcagggactctccaccctcctggaggccgcagcctgatggtgaggccagccagacagaagacgtggatggcacctggggctcttcagcagccaggtggagcgatcaggggccagcacagacttctcggcgaccctcccaaggccctcctgccagatcccccagtcaggacttctccttcattgaggacaccgagatcctcgacagtgccatgtatcggagccgtgccaacttggggcgcaagcgtgggcaccgggccccggtcattcggcctgggggtaccttgggcctgtcggaggcagcagactcggatgcacacctgttccaggactctacagagccacgggcatctcgggtgccatcttcagatgaagaggtagtggaggaacctcagagccgccggacacggatgtcgttgggcaccaaggggctgaaagtcaacctctttcctggcctgagcccctcagccctgaaggccaagctgcgcccccggaatcgctcagctgaggagggagagctggctgagagcaagtcgagccagaaggagtccgcggtccagcgttcgaaatcctgcaaggtcccaggactgggaaagcccctcacgttacctcccaagccagagaaatcctcagggtcagaaggatcgtcgcccaactggcttcaagccctgaaactgaagaagaagaaggtctgagaagtcactgaggttcttcccacctggcagtctcaggcagtgcccattcctgtggggtccctgggtgaggagacggctggagccccaccatgccccaggctgcagcctctgtcccctccacctctgaggagcgtctggggaggcacatttatgcactttgtatcaccctccgaactccccccacaccttcccttccctggatttcatcactagtggttgaaggttttgtcccttcctctcctccttccctctccctctctgcttcctcctccagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttgggaa

SEQ ID NO: 420204 - DNA, 1990 bp, Homo sapiens
gctgggagggggcagggcagcttcggaagcagaattgaaccaaggggacagtaccaccagggacggtgtggtgcggggagctttccagaagagggagcagctcgttcaaagccagcagcatgtgagggccgggtgtcttctgatggtccctggttgctctgtgagcctggggaatgaagaggcataacgtgggggctgaagacaacatgagtccggagaggcaggtgggccagtacctggctcaccccaaggagtgtgactgcccgagcacgtggccctgggagggaacacattgctagcatgcaacagcagcaggaataatggctgctgcttctgcggtgcgtgctgaccaggactgtgctaagtgctttagatttttctttcatccttgcagcgactccgtgcagttagaggagcctgagctgtttccaggggagggggctcacccgaggtctcagggatttgaacctgccagactggctcagctcttcacctgtgtgctgtgttgctcaaggccctgaccgtgtccttggagtctggaaaaagcatgggaaggagggcaagggagagtttgggggctgggggaaggagcttgtgaagtaggcttcagggcagggagatggggccttacgatgatctcgttctctctctgtcccctttacagccctggcaggtgcccggcccgccccccaccctccggctcccagggcctgctggaggagatgctggcagccagcagctccaaggcggtggctcggagggagtcagcggcctcgggccttgggggcctgttggaggaggaaggagccggggcaggtgctgcccaagaggaggtgctggagcctggcagggactctccaccctcctggaggccgcagcctgatggtgaggccagccagacagaagacgtggatggcacctggggctcttcagcagccaggtggagcgatcaggggccagcacagacttctcggcgaccctcccaaggccctcctgccagatcccccagtcaggacttctccttcattgaggacaccgagatcctcgacagtgccatgtatcggagccgtgccaacttggggcgcaagcgtgggcaccgggccccggtcattcggcctgggggtaccttgggcctgtcggaggcagcagactcggatgcacacctgttccaggactctacagagccacgggcatctcgggtgccatcttcagatgaagaggtagtggaggaacctcagagccgccggacacggatgtcgttgggcaccaaggggctgaaagtcaacctctttcctggcctgagcccctcagccctgaaggccaagctgcgcccccggaatcgctcagctgaggagggagagctggctgagagcaagtcgagccagaaggagtccgcggtccagcgttcgaaatcctgcaaggtcccaggactgggaaagcccctcacgttacctcccaagccagagaaatcctcagggtcagaaggatcgtcgcccaactggcttcaagccctgaaactgaagaagaagaaggtctgagaagtcactgaggttcttcccacctggcagtctcaggcagtgcccattcctgtggggtccctgggtgaggagacggctggagccccaccatgccccaggctgcagcctctgtcccctccacctctgaggagcgtctggggaggcacatttatgcactttgtatcaccctccgaactccccccacaccttcccttccctggatttcatcactagtggttgaaggttttgtcccttcctctcctccttccctctccctctctgcttcctcctccagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttgggaa

SEQ ID NO: 420205 - DNA, 4022 bp, Homo sapiens
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccaggagctgggggttggtgagacaagtgggccagagacccagggtgaagattactcctcgtcttccttggagccacaccctgcagaccctggaatggagacaggagaagccctcagcttcggagcaagccctggcaggtgcccggcccgccccccaccctccggctcccagggcctgctggaggagatgctggcagccagcagctccaaggcggtggctcggagggagtcagcggcctcgggccttgggggcctgttggaggaggaaggagccggggcaggtgctgcccaagaggaggtgctggagcctggcagggactctccaccctcctggaggccgcagcctgatggtgaggccagccagacagaagacgtggatggcacctggggctcttcagcagccaggtggagcgatcaggggccagcacagacttctcggcgaccctcccaaggccctcctgccagatcccccagtcaggacttctccttcattgaggacaccgagatcctcgacagtgccatgtatcggagccgtgccaacttggggcgcaagcgtgggcaccgggccccggtcattcggcctgggggtaccttgggcctgtcggaggcagcagactcggatgcacacctgttccaggactctacagagccacgggcatctcgggtgccatcttcagatgaagaggtagtggaggaacctcagagccgccggacacggatgtcgttgggcaccaaggggctgaaagtcaacctctttcctggcctgagcccctcagccctgaaggccaagctgcgcccccggaatcgctcagctgaggagggagagctggctgagagcaagtcgagccagaaggagtccgcggtccagcgttcgaaatcctgcaaggtcccaggactgggaaagcccctcacgttacctcccaagccagagaaatcctcagggtcagaaggatcgtcgcccaactggcttcaagccctgaaactgaagaagaagaaggtctgagaagtcactgaggttcttcccacctggcagtctcaggcagtgcccattcctgtggggtccctgggtgaggagacggctggagccccaccatgccccaggctgcagcctctgtcccctccacctctgaggagcgtctggggaggcacatttatgcactttgtatcaccctccgaactccccccacaccttcccttccctggatttcatcactagtggttgaaggttttgtcccttcctctcctccttccctctccctctctgcttcctcctccagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttgggaaaaaaaaggagtgaaaataaaaaaaagaataaaacagaaaaaaagggcgggggggataaaaaatccag

SEQ ID NO: 420206 - DNA, 4372 bp, Homo sapiens
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccaggagctgggggttggtgagacaagtgggccagagacccagggtgaagattactcctcgtcttccttggagccacaccctgcagaccctggaatggagacaggagaagccctcagcttcggagcaagccctggcaggtgcccggcccgccccccaccctccggctcccagggcctgctggaggagatgctggcagccagcagctccaaggcggtggctcggagggagtcagcggcctcgggccttgggggcctgttggaggaggaaggagccggggcaggtgctgcccaagaggaggtgctggagcctggcagggactctccaccctcctggaggccgcagcctgatggtgaggccagccagacagaagacgtggatggcacctggggctcttcagcagccaggtggagcgatcaggggccagcacagacttctcggcgaccctcccaaggccctcctgccagatcccccagtcaggacttctccttcattgaggacaccgagatcctcgacagtgccatgtatcggagccgtgccaacttggggcgcaagcgtgggcaccgggccccggtcattcggcctgggggtaccttgggcctgtcggaggcagcagactcggatgcacacctgttccaggactctacagagccacgggcatctcgggtgccatcttcagatgaagaggtagtggaggaacctcagagccgccggacacggatgtcgttgggcaccaaggggctgaaagtcaacctctttcctggcctgagcccctcagccctgaaggccaagctgcgcccccggaatcgctcagctgaggagggagagctggctgagagcaagtcgagccagaaggagtccgcggtccagcgttcgaaatcctgcaaggtcccaggactgggaaagcccctcacgttacctcccaagccagagaaatcctcagggtcagaaggatcgtcgcccaactggcttcaagccctgaaactgaagaagaagaaggtctgagaagtcactgaggttcttcccacctggcagtctcaggcagtgcccattcctgtggggtccctgggtgaggagacggctggagccccaccatgccccaggctgcagcctctgtcccctccacctctgaggagcgtctggggaggcacatttatgcactttgtatcaccctccgaactccccccacaccttcccttccctggatttcatcactagtggttgaaggttttgtcccttcctctcctccttccctctccctctctgcttcctcctccagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttgggaacaaaaaaaaaaaaaaaaaaaaaaaaaaaaacagtgtggggggggcccgggccccgggaaaagttaaaaccatcgggtgggggggggggccccaatgggaaggggaaaaggggcaaagggggtcagggaaacaccggggcagacataaggggtggggatttcctcccaagtaaaaaacagcccccggggggaaccacgcgacgggtttgggaaacaaatcccgaaggaggggggttcggagggtcacatcgggggacttacacaaagggggatccgaggcgaggaccggattatccaaaatgacgcccacggcgcgggatggacacgaaagagaagtcaacaggacacacaacgaaagagacaaaccgaacgatgaaacgagagagcaatggaggacacaacagcgacagcgcacagc

SEQ ID NO: 420207 - DNA, 3768 bp, Homo sapiens
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccaggagctgggggttggtgagacaagtgggccagagacccagggtgaagattactcctcgtcttccttggagccacaccctgcagaccctggaatggagacaggagaagccctcagcttcggagcaagccctggcaggtgcccggcccgccccccaccctccggctcccagggcctgctggaggagatgctggcagccagcagctccaaggcggtggctcggagggagtcagcggcctcgggccttgggggcctgttggaggaggaaggagccggggcaggtgctgcccaagaggaggtgctggagcctggcagggactctccaccctcctggaggccgcagcctgatggtgaggccagccagacagaagacgtggatggcacctggggctcttcagcagccaggtggagcgatcaggggccagcacagacttctcggcgaccctcccaaggccctcctgccagatcccccagtcaggacttctccttcattgaggacaccgagatcctcgacagtgccatgtatcggagccgtgccaacttggggcgcaagcgtgggcaccgggccccggtcattcggcctgggggtaccttgggcctgtcggaggcagcagactcggatgcacacctgttccaggactctacagagccacgggcatctcgggtgccatcttcagatgaagaggtagtggaggaacctcagagccgccggacacggatgtcgttgggcaccaaggggctgaaagtcaacctctttcctggcctgagcccctcagccctgaaggccaagctgcgcccccggaatcgctcagctgaggagggagagctggctgagagcaagtcgagccagaaggagtccgcggtccagcgttcgaaatcctgcaaggtcccaggactgggaaagcccctcacgttacctcccaagccagagaaatcctcagggtcagaaggatcgtcgcccaactggcttcaagccctgaaactgaagaagaagaaggtctgagaagtcactgaggttcttcccacctggcagtctcaggcagtgcccattcctgtggggtccctgggtgaggagacggctggagccccaccatgccccaggctgcagcctctgtcccctccacctctgaggagcgtctggggaggcacatttatgcactttgtatcaccctccgaactccccccacaccttcccttccctggatttcatcactagtggttgaaggttttgtcccttcctctctctctaaagcatgggatcctctaga

SEQ ID NO: 420208 - DNA, 830 bp, Homo sapiens
cccctttcccgggcctttgcagagccacgggcatctcgggtgccatcttcagatgaagaggtagtggaggaacctcagagccgccggacacggatgtcgttgggcaccaaggggctgaaagtcaacctctttcctggcctgagcccctcagccctgaaggccaagctgcgcccccggaatcgctcagctgaggagggagagctggctgagagcaagtcgagccagaaggagtccgcggtccagcgttcgaaatcctgcaaggtcccaggactgggaaagcccctcacgttacctcccaagccagagaaatcctcagggtcagaaggatcgtcgcccaactggcttcaagccctgaaactgaagaagaagaaggtctgagaagtcactgaggttcttcccacctggcagtctcaggcagtgcccattcctgtggggtccctgggtgaggagacggctggagccccaccatgccccaggctgcagcctctgtcccctccacctctgaggagcgtctggggaggcacatttatgcactttgtatcaccctccgaactccccccacaccttcccttccctggatttcatcactagtggttgaaggttttgtcccttcctctcctccttccctctccctctctgcttcctcctccagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttgggaa

SEQ ID NO: 420209 - DNA, 3732 bp, Homo sapiens
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccaggagctgggggttggtgagacaagtgggccagagacccagggtgaagattactcctcgtcttccttggagccacaccctgcagaccctggaatggagacaggagaagccctcagcttcggagcaagccctggcaggtgcccggcccgccccccaccctccggctcccagggcctgctggaggagatgctggcagccagcagctccaaggcggtggctcggagggagtcagcggcctcgggccttgggggcctgttggaggaggaaggagccggggcaggtgctgcccaagaggaggtgctggagcctggcagggactctccaccctcctggaggccgcagcctgatggtgaggccagccagacagaagacgtggatggcacctggggctcttcagcagccaggtggagcgatcaggggccagcacagacttctcggcgaccctcccaaggccctcctgccagatcccccagtcaggacttctccttcattgaggacaccgagatcctcgacagtgccatgtatcggagccgtgccaacttggggcgcaagcgtgggcaccgggccccggtcattcggcctgggggtaccttgggcctgtcggaggcagcagactcggatgcacacctgttccaggactctacagagccacgggcatctcgggtgccatcttcagatgaagaggtagtggaggaacctcagagccgccggacacggatgtcgttgggcaccaaggggctgaaagtcaacctctttcctggcctgagcccctcagccctgaaggccaagctgcgcccccggaatcgctcagctgaggagggagagctggctgagagcaagtcgagccagaaggagtccgcggtccagcgttcgaaatcctgcaaggtcccaggactgggaaagcccctcacgttacctcccaagccagagaaatcctcagggtcagaaggatcgtcgcccaactggcttcaagccctgaaactgaagaagaagaaggtctgagaagtcactgaggttcttcccacctggcagtctcaggcagtgcccattcagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttgggaa

SEQ ID NO: 420210 - DNA, 3611 bp, Homo sapiens
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccaggagctgggggttggtgagacaagtgggccagagacccagggtgaagattactcctcgtcttccttggagccacaccctgcagaccctggaatggagacaggagaagccctcagcttcggagcaagccctggcaggtgcccggcccgccccccaccctccggctcccagggcctgctggaggagatgctggcagccagcagctccaaggcggtggctcggagggagtcagcggcctcgggccttgggggcctgttggaggaggaaggagccggggcaggtgctgcccaagaggaggtgctggagcctggcagggactctccaccctcctggaggccgcagcctgatggtgaggccagccagacagaagacgtggatggcacctggggctcttcagcagccaggtggagcgatcaggggccagcacagacttctcggcgaccctcccaaggccctcctgccagatcccccagtcaggacttctccttcattgaggacaccgagatcctcgacagtgccatgtatcggagccgtgccaacttggggcgcaagcgtgggcaccgggccccggtcattcggcctgggggtaccttgggcctgtcggaggcagcagactcggatgcacacctgttccaggactctacagagccacgggcatctcgggtgccatcttcagatgaagaggtagtggaggaacctcagagccgccggacacggatgtcgttgggcaccaaggggctgaaagtcaacctctttcctggcctgagcccctcagccctgaaggccaagctgcgcccccggaatcgctcagctgaggagggagagctggctgagagcaagtcgagccagaaggagtccgcggtccagcgttcgaaatcctgcaaggtcccaggactgggaaagcccctcacgttacctcccaagccagagaaatcctcagggtcagaaggatcgtcgcccaactggcttcaagccctgaaactgaagaagaagaaggtctgagaagtcactgaggttcttcccacctggcagtctcaggcagtgcccattcagggctcaggccaggaaagaggttgactttcagcccctagagtgtcgaatcctcggact

SEQ ID NO: 420211 - DNA, 3609 bp, Homo sapiens
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccaggagctgggggttggtgagacaagtgggccagagacccagggtgaagattactcctcgtcttccttggagccacaccctgcagaccctggaatggagacaggagaagccctcagcttcggagcaagccctggcaggtgcccggcccgccccccaccctccggctcccagggcctgctggaggagatgctggcagccagcagctccaaggcggtggctcggagggagtcagcggcctcgggccttgggggcctgttggaggaggaaggagccggggcaggtgctgcccaagaggaggtgctggagcctggcagggactctccaccctcctggaggccgcagcctgatggtgaggccagccagacagaagacgtggatggcacctggggctcttcagcagccaggtggagcgatcaggggccagcacagacttctcggcgaccctcccaaggccctcctgccagatcccccagtcaggacttctccttcattgaggacaccgagatcctcgacagtgccatgtatcggagccgtgccaacttggggcgcaagcgtgggcaccgggccccggtcattcggcctgggggtaccttgggcctgtcggaggcagcagactcggatgcacacctgttccaggactctacagagccacgggcatctcgggtgccatcttcagatgaagaggtagtggaggaacctcagagccgccggacacggatgtcgttgggcaccaaggggctgaaagtcaacctctttcctggcctgagcccctcagccctgaaggccaagctgcgcccccggaatcgctcagctgaggagggagagctggctgagagcaagtcgagccagaaggagtccgcggtccagcgttcgaaatcctgcaaggtcccaggactgggaaagcccctcacgttacctcccaagccagagaaatcctcagggtcagaaggatcgtcgcccaactggcttcaagccctgaaactgaagaagaagaaggtctgagaagtcactgaggttcttcccacctggcagtctcaggcagtgcccattccccacagagaccaatgacattttgccacttgaaacaataaataaagttttttgggaa

SEQ ID NO: 420212 - DNA, 3149 bp, Homo sapiens
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccaggagctgggggttggtgagacaagtgggccagagacccagggtgaagattactcctcgtcttccttggagccacaccctgcagaccctggaatggagacaggagaagccctcagcttcggagcaagccctggcaggtgcccggcccgccccccaccctccggctcccagggcctgctggaggagatgctggcagccagcagctccaaggcggtggctcggagggagtcagcggcctcgggccttgggggcctgttggaggaggaaggagccggggcaggtgctgcccaagaggaggtgctggagcctggcagggactctccaccctcctggaggccgcagcctgatggtgaggccagccagacagaagacgtggatggcacctggggctcttcagcagccaggtggagcgatcaggggccagcacagacttctcggcgaccctcccaaggccctcctgccagatcccccagtcaggacttctccttcattgaggacaccgagatcctcgacagtgccgatgaatagcgaggtgccgatgaatagcgaggcacctttttttttctataaatttgttgaagttcagttccttacagatgacggatatcagacctttgttggatgcaaagtttacgtgccgaggatagc

SEQ ID NO: 420213 - DNA, 3521 bp, Homo sapiens
  misc_feature (3502)..(3502): n is a, c, g, or t
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccaggagctgggggttggtgagacaagtgggccagagacccagggtgaagattactcctcgtcttccttggagccacaccctgcagaccctggaatggagacaggagaagccctcagcttcggagcaaggtaatgaacggagccccatcccaagtgtgggagggaacatgtgaaggctgtccaagaaatcggaacctttctgaggagggaagaaacagtttttcctgaggacttttagtgtttgggtaattgagacattttggactaagaatttttagttctacttaaaaataattgaaatatgatacacatacaggtgagttcctttttttgaaggatgactaatgtgttacttttgcaacccatgtttgagcttggtgatttggaattgtgactgtgacgggggaaatggtgcatgtcatagcttggatggtttctgatgggttctactcttgtacacagtagccgttccccaggcctctcagccctgaagccacaggtggtttcataggtatagggcagagaattccgtgtcttcttggctggggccaccacagccaggagtggagtggacagtggaacccacgggttctcaaagaggttaggtacttggtgcttcttgcctgtcctgtcttgaagcctggaatagcaagttcaagaacctgaagggtatggggacctggccccatgaccttggcctctgtgcaaatttgctgaaagaactttccaaaggctttgcaaggcaagcacagtctgtttcatggatgttttaaaaccagctgagatggttttgcagctgagaaacgtgctaaaaaggcattgcatccgttttgttaacatttccatccattgagattcgcttttattccctttagtgagcagaaaatgttaaccttttccagccccccaacagctgctatgggggggctaaattatctctactttgtagagaggatctatatttgtagggggttcgggcccaggcccggtccctatctctgngataaactgtcagaccgtg

SEQ ID NO: 420214 - DNA, 3800 bp, Homo sapiens
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccaggagctgggggttggtgagacaagtgggccagagacccagggtgaagattactcctcgtcttccttggagccacaccctgcagaccctggaatggagacaggagaagccctcagcttcggagcaaggtaatgaacggagccccatcccaagtgtgggagggaacatgtgaaggctgtccaagaaatcggaacctttctgaggagggaagaaacagtttttcctgaggacttttagtgtttgggtaattgagacattttggactaagaatttttagttctacttaaaaataattgaaatatgatacacatacaggtgagttcctttttttgaaggatgactaatgtgttacttttgcaacccatgtttgagcttggtgatttggaattgtgactgtgacgggggaaatggtgcatgtcatagcttggatggtttctgatgggttctactcttgtacacagtagccgttccccaggcctctcagccctgaagccacaggtggtttcataggtatagggcagagaattccgtgtcttcttggctggggccaccacagccaggagtggagtggacagtggaacccacgggttctcaaagaggttaggtacttggtgcttcttgcctgtcctgtcttgaagcctggaatagcaagttcaagaacctgaagggtatggggacctggccccatgaccttggcctctgtgcaaatttgctgaaagaactttccaaaggctttgcaaggcaagcacagtctgtttcatggatgttttaaaaccagctgagatggttttgcagctgagaaacgtgctaaaaaggcattgcatccgttttgttaacatttccatccattgagattcgcttttattccctttagtgagcagaaaatgttaaccttttccagccccacagtgggagcttctcactgggtatgtggggaaggcaagggaagtgtggggcaggggcttttataagtggaaggggttggtggtgggaggagaggagcaggaaggggctagagcatatcatggtggtcttggggactctggagaggcatttgggatggaggagaggggagagaggaagatgggcccagtgagatgcccagggggatttgaggaagtggagcttcctgacgactcaggctgttgacggggtggtgacggagcacagggaaccactgaggctgcattgaggactgcagggacgaggggagggcgcaggactaggagttgggaggcccttgtggtcctgggcaggttgctgggctcttccgcccacacacccttatcctaaagattt

SEQ ID NO: 420215 - DNA, 3703 bp, Homo sapiens
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccaggagctgggggttggtgagacaagtgggccagagacccagggtgaagattactcctcgtcttccttggagccacaccctgcagaccctggaatggagacaggagaagccctcagcttcggagcaaggtaatgaacggagccccatcccaagtgtgggagggaacatgtgaaggctgtccaagaaatcggaacctttctgaggagggaagaaacagtttttcctgaggacttttagtgtttgggtaattgagacattttggactaagaatttttagttctacttaaaaataattgaaatatgatacacatacaggtgagttcctttttttgaaggatgactaatgtgttacttttgcaacccatgtttgagcttggtgatttggaattgtgactgtgacgggggaaatggtgcatgtcatagcttggatggtttctgatgggttctactcttgtacacagtagccgttccccaggcctctcagccctgaagccacaggtggtttcataggtatagggcagagaattccgtgtcttcttggctggggccaccacagccaggagtggagtggacagtggaacccacgggttctcaaagaggttaggtacttggtgcttcttgcctgtcctgtcttgaagcctggaatagcaagttcaagaacctgaagggtatggggacctggccccatgaccttggcctctgtgcaaatttgctgaaagaactttccaaaggctttgcaaggcaagcacagtctgtttcatggatgttttaaaaccagctgagatggttttgcagctgagaaacgtgctaaaaaggcattgcatccgttttgttaacatttccatccattgagattcgcttttattccctttagtgagcagaaaatgttaaccttttccagccccacagtgggagcttctcactgggtatgtggggaaggcaagggaagtgtggggcaggggcttttataagtggaaggggttggtggtgggaggagaggagcaggaaggggctagagcatatcatggtggtcttggggactctggagaggcatttgggatttattttattcctataggggctttcacagctttatggctgtcggaatttatgtccccaaacttgcagcaagtatggtgaaggcccctaaatttaattaaacttaggattttatactcttttggcggtgaacctcttatggt

SEQ ID NO: 420216 - DNA, 3795 bp, Homo sapiens
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccaggagctgggggttggtgagacaagtgggccagagacccagggtgaagattactcctcgtcttccttggagccacaccctgcagaccctggaatggagacaggagaagccctcagcttcggagcaaggtaatgaacggagccccatcccaagtgtgggagggaacatgtgaaggctgtccaagaaatcggaacctttctgaggagggaagaaacagtttttcctgaggacttttagtgtttgggtaattgagacattttggactaagaatttttagttctacttaaaaataattgaaatatgatacacatacaggtgagttcctttttttgaaggatgactaatgtgttacttttgcaacccatgtttgagcttggtgatttggaattgtgactgtgacgggggaaatggtgcatgtcatagcttggatggtttctgatgggttctactcttgtacacagtagccgttccccaggcctctcagccctgaagccacaggtggtttcataggtatagggcagagaattccgtgtcttcttggctggggccaccacagccaggagtggagtggacagtggaacccacgggttctcaaagaggttaggtacttggtgcttcttgcctgtcctgtcttgaagcctggaatagcaagttcaagaacctgaagggtatggggacctggccccatgaccttggcctctgtgcaaatttgctgaaagaactttccaaaggctttgcaaggcaagcacagtctgtttcatggatgttttaaaaccagctgagatggttttgcagctgagaaacgtgctaaaaaggcattgcatccgttttgttaacatttccatccattgagattcgcttttattccctttagtgagcagaaaatgttaaccttttccagccccacagtgggagcttctcactgggtatgtggggaaggcaagggaagtgtggggcaggggcttttataagtggaaggggttggtggtgggaggagaggagcaggaaggggctagagcatatcatggtggtcttggggactctggagaggcatttgggatggaggagaggggagagaggaagatgggcccagtgagatgcccagggggatttgaggaagtggagcttcctgacgactcaggctgttgacggggtggtgacggagcacagggaaccactgaggctgcattgaggactgcagggacgaggggagggcgcaggactaggagttgggaggcccttgtggtcctgggcaggttgctgggctctgagcctcagtttctcagggtttgac

SEQ ID NO: 420217 - DNA, 2517 bp, Homo sapiens
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttgggaa

SEQ ID NO: 420218 - DNA, 2537 bp, Homo sapiens
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttgggaaaattggtgctgtccaggtgg

SEQ ID NO: 420219 - DNA, 595 bp, Homo sapiens
gtctgtaaagttggatggaccatcaatgggaaaatgagagctgcccaccctggccttacactccttcaattaatacataaacagaaaggaggatatacagagagccaaaggcccatgggacgtgaccaacattccgctgagtctatacgatcaaacagcaaactgtttatcatgaatacagaatgtgggcagctgtggggtccctgggtgaggagacggctggagccccaccatgccccaggctgcagcctctgtcccctccacctctgaggagcgtctggggaggcacatttatgcactttgtatcaccctccgaactccccccacaccttcccttccctggatttcatcactagtggttgaaggttttgtcccttcctctcctccttccctctccctctctgcttcctcctccagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttgggaa

SEQ ID NO: 420220 - DNA, 2007 bp, Homo sapiens
  misc_feature (1995)..(1995): n is a, c, g, or t
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatctaacttcacccggggatcctntaaaagtcgacc

SEQ ID NO: 420221 - DNA, 397 bp, Homo sapiens
aagtcctgagtgctctgtctgctaatgaatacagattcttgaggatgggggttgagatcgccagagggacccccaaccacccatcagaccttccctcctaagattccagtccctccgaactccccccacaccttcccttccctggatttcatcactagtggttgaaggttttgtcccttcctctcctccttccctctccctctctgcttcctcctccagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttgggaa

SEQ ID NO: 420222 - DNA, 1633 bp, Homo sapiens
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatggcagcaccctcttcaggggatggtcccaggaggggccagtaaagtctccagcagagtgccgggaagagcacagcaagacccctgaggagaggagccttccttccgacctggccttcaacggggacctggctaaggcagccagctcggagctacagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttgggaa

SEQ ID NO: 420223 - DNA, 1357 bp, Homo sapiens
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtgagaaattgaacggggtcctctaagatcg

SEQ ID NO: 420224 - DNA, 1208 bp, Homo sapiens
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcggcaacacggggcagagcgcaacaccggg

SEQ ID NO: 420225 - DNA, 1319 bp, Homo sapiens
caattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctccgccatgcgttctcgcagtcacgaacgcttagcaggacgacggaccaggtagca

SEQ ID NO: 420226 - DNA, 1032 bp, Homo sapiens
  misc_feature (41)..(41): n is a, c, g, or t
cggcggcggggactggcatcggggccccgagccgagcggancggaccccgggcgagcgcgtctgcagccaccccagctcatacctctctgcctccccgctctcaaggagggtctgccgcatgtgatgaaagtgtctactctcagggaaagctcagccatggcttccccactgccccgggagatggaggaggagctggtgcctactggctctgagccaggtgacactcgggccaaaccccctgtcaagcccaaaccccgggccctgcctgccaagccagccctgcctgccaaacccagcctgctggtgcctgttgggcctcggcctccccggggtcccctggctgagttgccttctgccaggaagatgaacatgctggcaggaccccagccctatggtggcagcaagcgcccccttccctttgcaccaaggcctgcggttgaggcctccactggaggagaagccacccaagagactgggaaagaggaggctgggaaagaggagccaccccctttgacacccccagctcgatgtgcagccccagggggtgtacggaaggcccctgcccctttccgcccagcctcagagcgcttcgcggccaccacggtggaagagatcctggccaagatggagcagcctcggaaggaggtccttgccagccccgaccgcctgtggggttcccgcctcacctttaaccacgatggcagctcgcgatatggccccaggacctatggcacgaccactgctcccagggatgaggatggcagcaccctcttcaggggatggtcccaggaggggccagtaaagtctccagcagagtgccgggaagagcacagcaagacccctgaggagaggagccttccttccgacctggccttcaacggggacctggctaaggcagccagctcggagctacctgctgatatttccaagccctggattccctcaagtccagccccctcctcagagaatggaggccctgccagcccaggcctccccgcagaagcctcaggctcaggccctggctctcccca

SEQ ID NO: 420227 - DNA, 467 bp, Homo sapiens
tgcctcttctggttagagggtggtttctgtccctatcacgtctccttgttgtgttcagtttcctcaaagtttgcattctggacctttgccgtctgcctcctaggtcagaaggatcgtcgcccaactggcttcaagccctgaaactgaagaagaagaaggtctgagaagtcactgaggtgaggacaggttcctgggcttggatccagtctgaggagggcctgccctggaggcttcggaggcctcatgccccttctgtcccttagctcccacccctttctgtgcaagtttagaaacagcaggtgaagccaagctccagagactcggtaggcccttggcttctctagattttgtccacagggaggtcaggttgttgtctggcctggtgtggaagaggagaagggctaccatcctggcctgcttccctgtgctcagggacagtccccccatgctccctggctggacggaga

SEQ ID NO: 420228 - DNA, 873 bp, Homo sapiens
gtccgtggctgtgcagcttgggtgtcctgtgctcggcttaggggcacaggcttgcgggcggacctagggacggcggaggcatcgtgtccttcctgcaggaaggaaggagcttccggagctttcctgggaggctcactggggccgcggagataacctgaggtcctgcaacaggctgggggcccaaggaccatcccaggccttggaacagttggtatctttcagtcgccgccctggagaggcaggtgtttgacttcctgggctaccagtgggcgcccatcctggccaactttgtccacatcatcatcgtcatcctgggactcttcggcaccatccagtaccggctgcgctacgtcatggtgtacacgctgtgggcagccgtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctgtgagtatggggcctctgcaggcagtggggcgggagacggctacagaggtggcagctctgagtctgtcccgtctggggcaaggcgagagacctccccacttggaagggacctcacgcccagcagggccttgctcacggccgtaggcctgagcgaggactcgccacacaccaggg

SEQ ID NO: 420229 - DNA, 588 bp, Homo sapiens
aactttatttacaaaagcagctggcagctctttggggtgctctcttgggggtggcttctggggtgctctgcagtggaggcctgtgctgtccacgtgtaatgtcagcccggtgaggcgaggacaggtcacggcagctcagccaggatgctgtgtccgtacgccgacctgcgctggggctcccttgagctggctgtcccaccgcctcattcccggggcacccacgtgggaaagctctgagacgtgtcccaggtgggcttgggggacccctttctccatgctgtgcatctgggggccgccagactcaggagcagaggccgcccctcctatgcgatcatgggaccccttcccccgggggctggatgcaagcaggtgtgcccgggagctgtgttcagccgccgccccatcctctcctctccctagtacacgctgtgggcagccgtctgggtcacctggaacgtcttcatcatctgcttctacctggaagtcggtggcctcttaaaggggctctctgctctggccagtgtagcacaggtgggcactggggcaggtgcccagccaggcagacgggcccccgcttcctggaaccac

SEQ ID NO: 420230 - DNA, 1438 bp, Homo sapiens
gagcgggtccaggctgcggcgcgtggggagcgggcggagcgggggcgggggccgagcgcggggcacccgggggcctcctgtataggcgggcaccatgggctcctgctccggccgctgcgcgctcgtcgtcctctgcgcttttcagctggtcgccgccctggagaggcaggtgtttgacttcctgggctaccagtgggcgcccatcctggccaactttgtccacatcatcatcgtcatcctgggactcttcggcaccatccagtaccggctgcgctacgtcatggtgtacacgctgtgggcagccgtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctttgatttcattggtggatttgatccatttcctctctaccatgtcaatgaaaagccatccagtctcttgtccaagcaggtgtacttgcctgcgtaagtgaggaaacagctgatcctgctcctgtggcctccagcctcagcgaccgaccagtgacaatgacaggagctcccaggccttgggacgcgcccccacccagcaccccccaggcggccggcagcacctgccctgggttctaagtactggacaccagccagggcggcagggcagtgccacggctggctgcagcgtcaagagagtttgtaatttcctttctcttaaaaaaaaaaaagaaaagaaaacatacaaaagaaaaggcaaaaccccacatgcccacctcctctggcaacatgggggtcacagctctgcccccaggctgtcgtctcgtcgaggagcccctccctcaggtgcccacctggggctgctggaccctcgggctgcaagcactgctgctgggatgcagcctccccaggaagtcaatgtgaggcccgagacccctcaagcggtgagggcccctgttgaacatggagggttcctaaccccaaactcgtgccagaagaacccccaccccacccaggagctgaggctgatggagccctagggtgggggctgggcttgaccaggaacagcagagccaggccccaaggcatagggcagggcacatggtggtgacgagcaggcagtactcttgtaaagggggctcttgggcaaacagtcccaaaggctcccccaggtatcatcaagttggtaaataaacaggaacatggccctcaaaaa

SEQ ID NO: 420231 - DNA, 1511 bp, Homo sapiens
gtccgtggctgtgcagcttgggtgtcctgtgctcggcttaggggcacaggcttgcgggcggacctagggacggcggaggcatcgtgtccttcctgcaggaaggaaggagcttccggagctttcctgggaggctcactggggccgcggagataacctgaggtcctgcaacaggctgggggcccaaggaccatcccaggccttggaacagttggtatctttcagtcgccgccctggagaggcaggtgtttgacttcctgggctaccagtgggcgcccatcctggccaactttgtccacatcatcatcgtcatcctgggactcttcggcaccatccagtaccggctgcgctacgtcatggtgtacacgctgtgggcagccgtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctttgatttcattggtggatttgatccatttcctctctaccatgtcaatgaaaagccatccagtctcttgtccaagcaggtgtacttgcctgcgtaagtgaggaaacagctgatcctgctcctgtggcctccagcctcagcgaccgaccagtgacaatgacaggagctcccaggccttgggacgcgcccccacccagcaccccccaggcggccggcagcacctgccctgggttctaagtactggacaccagccagggcggcagggcagtgccacggctggctgcagcgtcaagagagtttgtaatttcctttctcttaaaaaaaaaaaagaaaagaaaacatacaaaagaaaaggcaaaaccccacatgcccacctcctctggcaacatgggggtcacagctctgcccccaggctgtcgtctcgtcgaggagcccctccctcaggtgcccacctggggctgctggaccctcgggctgcaagcactgctgctgggatgcagcctccccaggaagtcaatgtgaggcccgagacccctcaagcggtgagggcccctgttgaacatggagggttcctaaccccaaactcgtgccagaagaacccccaccccacccaggagctgaggctgatggagccctagggtgggggctgggcttgaccaggaacagcagagccaggccccaaggcatagggcagggcacatggtggtgacgagcaggcagtactcttgtaaagggggctcttgggcaaacagtcccaaaggctcccccaggtatcatcaagttggtaaataaacaggaacatggccctcaaaaa

SEQ ID NO: 420232 - DNA, 1407 bp, Homo sapiens
gcagtccaactcccaccccgggccccggaccgcagctggtcgtagtggccgcggaggacggcagcttttgggggccgggcgggagaagcgtccgttcatccgcggaaccaagctgaggtcgccgccctggagaggcaggtgtttgacttcctgggctaccagtgggcgcccatcctggccaactttgtccacatcatcatcgtcatcctgggactcttcggcaccatccagtaccggctgcgctacgtcatggtgtacacgctgtgggcagccgtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctttgatttcattggtggatttgatccatttcctctctaccatgtcaatgaaaagccatccagtctcttgtccaagcaggtgtacttgcctgcgtaagtgaggaaacagctgatcctgctcctgtggcctccagcctcagcgaccgaccagtgacaatgacaggagctcccaggccttgggacgcgcccccacccagcaccccccaggcggccggcagcacctgccctgggttctaagtactggacaccagccagggcggcagggcagtgccacggctggctgcagcgtcaagagagtttgtaatttcctttctcttaaaaaaaaaaaagaaaagaaaacatacaaaagaaaaggcaaaaccccacatgcccacctcctctggcaacatgggggtcacagctctgcccccaggctgtcgtctcgtcgaggagcccctccctcaggtgcccacctggggctgctggaccctcgggctgcaagcactgctgctgggatgcagcctccccaggaagtcaatgtgaggcccgagacccctcaagcggtgagggcccctgttgaacatggagggttcctaaccccaaactcgtgccagaagaacccccaccccacccaggagctgaggctgatggagccctagggtgggggctgggcttgaccaggaacagcagagccaggccccaaggcatagggcagggcacatggtggtgacgagcaggcagtactcttgtaaagggggctcttgggcaaacagtcccaaaggctcccccaggtatcatcaagttggtaaataaacaggaacatggccctcaaaaa

SEQ ID NO: 420233 - DNA, 1572 bp, Homo sapiens
aactttatttacaaaagcagctggcagctctttggggtgctctcttgggggtggcttctggggtgctctgcagtggaggcctgtgctgtccacgtgtaatgtcagcccggtgaggcgaggacaggtcacggcagctcagccaggatgctgtgtccgtacgccgacctgcgctggggctcccttgagctggctgtcccaccgcctcattcccggggcacccacgtgggaaagctctgagacgtgtcccaggtgggcttgggggacccctttctccatgctgtgcatctgggggccgccagactcaggagcagaggccgcccctcctatgcgatcatgggaccccttcccccgggggctggatgcaagcaggtgtgcccgggagctgtgttcagccgccgccccatcctctcctctccctagtacacgctgtgggcagccgtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctttgatttcattggtggatttgatccatttcctctctaccatgtcaatgaaaagccatccagtctcttgtccaagcaggtgtacttgcctgcgtaagtgaggaaacagctgatcctgctcctgtggcctccagcctcagcgaccgaccagtgacaatgacaggagctcccaggccttgggacgcgcccccacccagcaccccccaggcggccggcagcacctgccctgggttctaagtactggacaccagccagggcggcagggcagtgccacggctggctgcagcgtcaagagagtttgtaatttcctttctcttaaaaaaaaaaaagaaaagaaaacatacaaaagaaaaggcaaaaccccacatgcccacctcctctggcaacatgggggtcacagctctgcccccaggctgtcgtctcgtcgaggagcccctccctcaggtgcccacctggggctgctggaccctcgggctgcaagcactgctgctgggatgcagcctccccaggaagtcaatgtgaggcccgagacccctcaagcggtgagggcccctgttgaacatggagggttcctaaccccaaactcgtgccagaagaacccccaccccacccaggagctgaggctgatggagccctagggtgggggctgggcttgaccaggaacagcagagccaggccccaaggcatagggcagggcacatggtggtgacgagcaggcagtactcttgtaaagggggctcttgggcaaacagtcccaaaggctcccccaggtatcatcaagttggtaaataaacaggaacatggccctcaaaaa

SEQ ID NO: 420234 - DNA, 1159 bp, Homo sapiens
ccctggcagagatctgcaggtgaatggacaccaccctcctggggccacgtggggtcctttgtcccagcccgaccaaccctccaggctggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctttgatttcattggtggatttgatccatttcctctctaccatgtcaatgaaaagccatccagtctcttgtccaagcaggtgtacttgcctgcgtaagtgaggaaacagctgatcctgctcctgtggcctccagcctcagcgaccgaccagtgacaatgacaggagctcccaggccttgggacgcgcccccacccagcaccccccaggcggccggcagcacctgccctgggttctaagtactggacaccagccagggcggcagggcagtgccacggctggctgcagcgtcaagagagtttgtaatttcctttctcttaaaaaaaaaaaagaaaagaaaacatacaaaagaaaaggcaaaaccccacatgcccacctcctctggcaacatgggggtcacagctctgcccccaggctgtcgtctcgtcgaggagcccctccctcaggtgcccacctggggctgctggaccctcgggctgcaagcactgctgctgggatgcagcctccccaggaagtcaatgtgaggcccgagacccctcaagcggtgagggcccctgttgaacatggagggttcctaaccccaaactcgtgccagaagaacccccaccccacccaggagctgaggctgatggagccctagggtgggggctgggcttgaccaggaacagcagagccaggccccaaggcatagggcagggcacatggtggtgacgagcaggcagtactcttgtaaagggggctcttgggcaaacagtcccaaaggctcccccaggtatcatcaagttggtaaataaacaggaacatggccctcaaaaa

SEQ ID NO: 420235 - DNA, 1244 bp, Homo sapiens
caatcctagtttggggctcagaataggtggctgcaccgcccctgggctgcccaggcccccagacacacctgatggcacgcccctgggtagcccctggctcttctctcctaaaaatgagggctgtcccggcaggggccgttcaaggtagcaggagcccagctcccatgtcagagaacaggggaataaagacctgggaaggggtggggtcacacgcagaccctgagccagggacccaggcacacccctgggtgagccccctctccactcccagccccacaggccagaccccactgagttgtcagcaaacaggcacaagacgctgacctgccggcacagggagaggcagtgggggctttccagagcctcagtcccacccatctcctttctgccaaaggcctgaagccgtccactgcttggactttgttccatttcaggttctccaaggggagggggtggcagcccccagtggccgccccagccctgttcccccaggtgctctctgaccttgtccccacaggcctgcgtaagtgaggaaacagctgatcctgctcctgtggcctccagcctcagcgaccgaccagtgacaatgacaggagctcccaggccttgggacgcgcccccacccagcaccccccaggcggccggcagcacctgccctgggttctaagtactggacaccagccagggcggcagggcagtgccacggctggctgcagcgtcaagagagtttgtaatttcctttctcttaaaaaaaaaaaagaaaagaaaacatacaaaagaaaaggcaaaaccccacatgcccacctcctctggcaacatgggggtcacagctctgcccccaggctgtcgtctcgtcgaggagcccctccctcaggtgcccacctggggctgctggaccctcgggctgcaagcactgctgctgggatgcagcctccccaggaagtcaatgtgaggcccgagacccctcaagcggtgagggcccctgttgaacatggagggttcctaaccccaaactcgtgccagaagaacccccaccccacccaggagctgaggctgatggagccctagggtgggggctgggcttgaccaggaacagcagagccaggccccaaggcatagggcagggcacatggtggtgacgagcaggcagtactcttgtaaagggggctcttgggcaaacagtcccaaaggctcccccaggtatcatcaagttggtaaataaacaggaacatggccctcaaaaa

SEQ ID NO: 420236 - DNA, 959 bp, Homo sapiens
cctgaggctgggctggcaagaagcccctcagccttgtcgggaaccctggcgtatgcatctggcaaggctggcgccacgtgacccagcttctgggctttgtctgtggctgccaggtggtcagcgtgtttacggaggaagaggacagctttgatttcattggtggatttgatccatttcctctctaccatgtcaatgaaaagccatccagtctcttgtccaagcaggtgtacttgcctgcgtaagtgaggaaacagctgatcctgctcctgtggcctccagcctcagcgaccgaccagtgacaatgacaggagctcccaggccttgggacgcgcccccacccagcaccccccaggcggccggcagcacctgccctgggttctaagtactggacaccagccagggcggcagggcagtgccacggctggctgcagcgtcaagagagtttgtaatttcctttctcttaaaaaaaaaaaagaaaagaaaacatacaaaagaaaaggcaaaaccccacatgcccacctcctctggcaacatgggggtcacagctctgcccccaggctgtcgtctcgtcgaggagcccctccctcaggtgcccacctggggctgctggaccctcgggctgcaagcactgctgctgggatgcagcctccccaggaagtcaatgtgaggcccgagacccctcaagcggtgagggcccctgttgaacatggagggttcctaaccccaaactcgtgccagaagaacccccaccccacccaggagctgaggctgatggagccctagggtgggggctgggcttgaccaggaacagcagagccaggccccaaggcatagggcagggcacatggtggtgacgagcaggcagtactcttgtaaagggggctcttgggcaaacagtcccaaaggctcccccaggtatcatcaagttggtaaataaacaggaacatggccctcaaaaa

SEQ ID NO: 420237 - DNA, 1426 bp, Homo sapiens
gtccgtggctgtgcagcttgggtgtcctgtgctcggcttaggggcacaggcttgcgggcggacctagggacggcggaggcatcgtgtccttcctgcaggaaggaaggagcttccggagctttcctgggaggctcactggggccgcggagataacctgaggtcctgcaacaggctgggggcccaaggaccatcccaggccttggaacagttggtatctttcagtcgccgccctggagaggcaggtgtttgacttcctgggctaccagtgggcgcccatcctggccaactttgtccacatcatcatcgtcatcctgggactcttcggcaccatccagtaccggctgcgctacgtcatggtgtacacgctgtgggcagccgtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctgcctgcgtaagtgaggaaacagctgatcctgctcctgtggcctccagcctcagcgaccgaccagtgacaatgacaggagctcccaggccttgggacgcgcccccacccagcaccccccaggcggccggcagcacctgccctgggttctaagtactggacaccagccagggcggcagggcagtgccacggctggctgcagcgtcaagagagtttgtaatttcctttctcttaaaaaaaaaaaagaaaagaaaacatacaaaagaaaaggcaaaaccccacatgcccacctcctctggcaacatgggggtcacagctctgcccccaggctgtcgtctcgtcgaggagcccctccctcaggtgcccacctggggctgctggaccctcgggctgcaagcactgctgctgggatgcagcctccccaggaagtcaatgtgaggcccgagacccctcaagcggtgagggcccctgttgaacatggagggttcctaaccccaaactcgtgccagaagaacccccaccccacccaggagctgaggctgatggagccctagggtgggggctgggcttgaccaggaacagcagagccaggccccaaggcatagggcagggcacatggtggtgacgagcaggcagtactcttgtaaagggggctcttgggcaaacagtcccaaaggctcccccaggtatcatcaagttggtaaataaacaggaacatggccctcaaaaa

SEQ ID NO: 420238 - DNA, 1353 bp, Homo sapiens
gagcgggtccaggctgcggcgcgtggggagcgggcggagcgggggcgggggccgagcgcggggcacccgggggcctcctgtataggcgggcaccatgggctcctgctccggccgctgcgcgctcgtcgtcctctgcgcttttcagctggtcgccgccctggagaggcaggtgtttgacttcctgggctaccagtgggcgcccatcctggccaactttgtccacatcatcatcgtcatcctgggactcttcggcaccatccagtaccggctgcgctacgtcatggtgtacacgctgtgggcagccgtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctgcctgcgtaagtgaggaaacagctgatcctgctcctgtggcctccagcctcagcgaccgaccagtgacaatgacaggagctcccaggccttgggacgcgcccccacccagcaccccccaggcggccggcagcacctgccctgggttctaagtactggacaccagccagggcggcagggcagtgccacggctggctgcagcgtcaagagagtttgtaatttcctttctcttaaaaaaaaaaaagaaaagaaaacatacaaaagaaaaggcaaaaccccacatgcccacctcctctggcaacatgggggtcacagctctgcccccaggctgtcgtctcgtcgaggagcccctccctcaggtgcccacctggggctgctggaccctcgggctgcaagcactgctgctgggatgcagcctccccaggaagtcaatgtgaggcccgagacccctcaagcggtgagggcccctgttgaacatggagggttcctaaccccaaactcgtgccagaagaacccccaccccacccaggagctgaggctgatggagccctagggtgggggctgggcttgaccaggaacagcagagccaggccccaaggcatagggcagggcacatggtggtgacgagcaggcagtactcttgtaaagggggctcttgggcaaacagtcccaaaggctcccccaggtatcatcaagttggtaaataaacaggaacatggccctcaaaaa

SEQ ID NO: 420239 - DNA, 2285 bp, Homo sapiens
aataaaagtaccagtgtagcaagtgaagaccaaatttatagcactgtgcattagatagcaaaatcaggttcttaacaatgaaaagtaaacctcaagtttctaaatccatatgcagatggttaggctgtccctctcttagcaaatctctcagcctccttctttcccaagtgccaaggatccctggagtaaagctctggggtctgtgctctctttctgtgaggggaaggctgcggccctatttgcccctctctagcaaacacccccaccaccctgccgcttcctgtggttattgagccagctaggagttactcatggactctaacctggttttagtcccatgtacatcgttgttttaggtttcatactgaagagccaatggtttatgtggttttattctgtcttaaatataagtttcaaggaagggaaaacaaaagtgataaaatgatagaacagtctagaggccactgtaaagtcaccgccactttacgtgtatgtcagtcttggtgttcttgtatgagtaaaatggatgtaaaatcataaaatcacagtgaatgtttcaggctacactggaaaaagtatgcacttagaattaaaggaaattgtataattcaccaagatttctttgtgtagatcaggggttggcaactatgacccacaggctaagactggtcagcggtctggtttttcacagccatgagctaagttacctttttaaagggttatataagtaattacatcatatttttgattttgcctttggcccacaccacataaaatattcaatacctggccttttttttttttttttgagacagagtctcgctctgtcacccaggatagagtgcactggtgcgattttggctcactgcaacctcttcctcctgggttcaagcaattctccctgcctcagcctctaagtagctgggactacaggcacccactaccatgccttgctaatttttgtatttttaatagagatggggtttcaccatgttggccaggctggtctcgaactcctgacctcaggggatccgcccgccttggcctcccaaactgctgggattacaggtgagccactgcgcccagccaatacctggccttttaagaagtttgctgactcctggtatggatgacagaaaatggaataacgttttgtttctccagtctaggaaaagcaagtcaggtagtggatagactgactggcgtccggggagcccagggtatgtgagggccacgtggatggaagcaaatgcctcctgcatagcccttggctctttgtcccacttgggaggagtccatggatgtaatatttacaaaacaattttttccttaccatttgcagaaagcattgcatatatttccttttagctcaggaaactggcatgccccaccctctgctactccatcagatgtaaatacaatgactataagccgtacaactcccctctcttagaaacctcagcaggaccacagagcaagggagtcaaagctttcttaattctctccagtaaatgactcaactaatttgatttttttaattaagtcaaaatatcaagagaaaaattgctactaaaacttacattttgatccacactgatgtgcaacacaaaatgaaagttttcacctccatttccattttttaaaaattcacggtccacactgaaacttgctgggttttagcaggagacaaaggtgtcacccacgctgtcctcatcctgctctctctgtcccagtgacgctccagcatatgatcactgcagccggtccctggcccgtgccgattctgccacctcccagccacacacatttgcagacccacaagaagaactgtagccttgataatttcagttcaggctggaaaaatgccatgcaataatctggtttgctttcagtaagtaggcaacaagtgaaaactgtataattttcatcacctattctgctgttctatctaaaatgagtgtacctgtggtttgtgaactgggcccttgtttgtgccagatccttcaaagatgttccctgtcaggacacctgtggccctgcccctcctcagacacctttccactggcattcacgttccttatatgcagtgttagccatctttggcctacgtggactttttttgtaaattacaccatttccagacattaaactttttatattatgaaatttaccatgtaaaaagaacttcatatttttattgagattgctaaggcacttggccttcctcctttgtgattttcagtgtctattaaagcatgagttccctcagttttaaaaaaaaaaac

SEQ ID NO: 420240 - DNA, 937 bp, Homo sapiens
cgcagggggactagagaggaccccccttagagacaaaggcgactgttatctcttataaaagctgagaatgcttcagggatgtctgatatctaaacaacaagaaaagccactcagcaggaccacagagcaagggagtcaaagctttcttaattctctccagtaaatgactcaactaatttgatttttttaattaagtcaaaatatcaagagaaaaattgctactaaaacttacattttgatccacactgatgtgcaacacaaaatgaaagttttcacctccatttccattttttaaaaattcacggtccacactgaaacttgctgggttttagcaggagacaaaggtgtcacccacgctgtcctcatcctgctctctctgtcccagtgacgctccagcatatgatcactgcagccggtccctggcccgtgccgattctgccacctcccagccacacacatttgcagacccacaagaagaactgtagccttgataatttcagttcaggctggaaaaatgccatgcaataatctggtttgctttcagtaagtaggcaacaagtgaaaactgtataattttcatcacctattctgctgttctatctaaaatgagtgtacctgtggtttgtgaactgggcccttgtttgtgccagatccttcaaagatgttccctgtcaggacacctgtggccctgcccctcctcagacacctttccactggcattcacgttccttatatgcagtgttagccatctttggcctacgtggactttttttgtaaattacaccatttccagacattaaactttttatattatgaaatttaccatgtaaaaagaacttcatatttttattgagattgctaaggcacttggccttcctcctttgtgattttcagtgtctattaaagcatgagttccctcagttttaaaaaaaaaaac

SEQ ID NO: 420241 - DNA, 86 bp, Homo sapiens
ctgatcaggccaaagttggagaaccactgactttaagattctagcaggcatcaccactttgaaaatacctgtctgactactcaagg

SEQ ID NO: 420242 - DNA, 1146 bp, Homo sapiens
ccaccagcccgtctggtttgtctagtcccattttcaccccacatccagagttactattattaccaactcctgagcatttgcaggattctgtagtatgaattgggatgcttcttggctttccctacagccagcttagaattgtgctttctcaggtctactaagttcaataccatccttcagcctgctctccagtttccaacatgttactgttaaggccttttccctcattttctatcattgtgagtatgtgccctttgaaaacccttttgctgtcatttttgtgggatttggtgaagaagcagtggtaaatgcatgtattattctgtcatctaagtgttcactgttagctcttctcataagtgggatgctaggcctcagttgctttctctgtgaaatgagaggatcatactaactggataatttgtaaaattcctttcatcccagactttttatgattctgtagtacttactgttaagtcaaacacagttcttccttttttctgaaataatttctctttgtcttaaatccttaaagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttgcttttttaaaaaactgataaaaaaaaaatgtatttgcatcatgct

SEQ ID NO: 420243 - DNA, 657 bp, Homo sapiens
  misc_feature (43)..(43): n is a, c, g, or t
gactcctagaggattccccactgctcataatagcgcaagcaancagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttgcttttttaaaaaactgataaaaaaaaaatgtatttgcatcatgct

SEQ ID NO: 420244 - DNA, 481 bp, Homo sapiens
gcctggcccatagtaggaacacagtagatacctcttgaatcaaagcctaaaacagtcatgacttgggccagttactcaatggggtgagtcccaggattagtgtgatctgccagtctgaggctagaactaaccttttcaggcaaaatgttattgtttctttgttttttccctctagtgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacaggtatgttttagccattcatagcaggatgtattgcctccctaaaaggatacaattaccttttagaagtcaactatga

SEQ ID NO: 420245 - DNA, 355 bp, Homo sapiens
acccggctcaacgaaggaagttcagggcgggaccagagattggccattccgctactgcgcaaagatggtggaggaggagaacatccgcgtggttcgttgtggcggcagcgagttgaactttaggagagctgtgttctctgcagattctaagtatatcttctgtgtctctggagactttgttaaagtttacagcacagttacagaagagtgtgtacacatactgcatggacacagaaatctggtgactggaatccagcttaaccccaacaaccatctacaggttcccttacatgcattgcgaatatccaaaagagtcacagccaacttggaagttattgattaaggatggatttgc

SEQ ID NO: 420246 - DNA, 2724 bp, Homo sapiens
acccggctcaacgaaggaagttcagggcgggaccagagattggccattccgctactgcgcaaagatggtggaggaggagaacatccgcgtggttcgttgtggcggcagcgagttgaactttaggagagctgtgttctctgcagattctaagtatatcttctgtgtctctggagactttgttaaagtttacagcacagttacagaagagtgtgtacacatactgcatggacacagaaatctggtgactggaatccagcttaaccccaacaaccatctacagctgtattcttgttcccttgatggcacaattaaactgtgggactatatagatggcatcttaataaagactttcatagttggatgtaaacttcatgccctctttactcttgcccaagctgaggattctgtctttgttatagtgaataaagaaaaaccagatatatttcagctggtttcagtgaaactgccaaaatcctcaagccaggaagtagaagccaaggagctgtcctttgttttggattacataaaccagtcacccaagtgcattgcctttggaaacgagggagtatatgttgctgcagtacgggaattttacttgtctgtttattttttcaaaaagaaaacaacatcaaggtttactttatcatcatcaagaaataagaagcatgctaaaaacaattttacgtgtgtagcatgtcacccaacggaagactgcatcgcatctggtcacatggatggcaaaattcgtctttggaggaatttttatgatgataagaaatatacgtacacatgtttacattggcaccatgatatggttatggatttggctttttcagtgacaggcaccagtctgctgagtggcggtcgtgaatctgtacttgtagagtggcgcgatgcaacagagaagaataaggagtttctcccgcgtttaggagctactattgaacatatctcagtctcgcctgcaggagatttattctgcacttctcactctgataataagataataattattcaccgaaaccttgaagcatccgcagtaattcaaggcctagtgaaagataggagtatcttcactggtttgatgattgatccaagaactaaagctttggttttgaatggaaaacctggccacctgcagttttattctctccagagtgataaacagttatacaatttagatattatacagcaagaatatattaatgattatggtctgatccaaattgaactaacaaaggctgcatttggctgctttggtaactggcttgcaacagtggaacagcggcaagaaaaggaaactgagcttgaattgcaaatgaaactgtggatgtataataagaaaacacaagggtttattcttaacactaaaattaacatgccacacgaagactgcattacagctctctgtttctgtaatgcagaaaaatctgaacagcccaccttggttacagctagcaaagatggttacttcaaagtatggatattaacagatgactctgacatatacaaaaaagctgttggctggacctgtgactttgttggtagttatcacaagtatcaagcaactaactgttgtttctccgaagatggttctttactagcagttagttttgaggaaatagtcacaatatgggattctgtaacatgggaacttaaatgtacattttgccaacgagctgggaaaataaggcacctttgctttgggagattgacgtgttcaaagtatctacttggtgctactgaaaatggcattctttgctgttggaatctgctgagctgtgcattggagtggaatgcaaaattaaatgttagagttatggaacccgatcctaattcagagaatattgctgcaatctctcagtcttcagtgggttcagacttgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttgcttttttaaaaaactgataaaaaaaaaatgtatttgcatcatgct

SEQ ID NO: 420247 - DNA, 2679 bp, Homo sapiens
acccggctcaacgaaggaagttcagggcgggaccagagattggccattccgctactgcgcaaagatggtggaggaggagaacatccgcgtggttcgttgtggcggcagcgagttgaactttaggagagctgtgttctctgcagattctaagtatatcttctgtgtctctggagactttgttaaagtttacagcacagttacagaagagtgtgtacacatactgcatggacacagaaatctggtgactggaatccagcttaaccccaacaaccatctacagctgtattcttgttcccttgatggcacaattaaactgtgggactatatagatggcatcttaataaagactttcatagttggatgtaaacttcatgccctctttactcttgcccaagctgaggattctgtctttgttatagtgaataaagaaaaaccagatatatttcagctggtttcagtgaaactgccaaaatcctcaagccaggaagtagaagccaaggagctgtcctttgttttggattacataaaccagtcacccaagtgcattgcctttggaaacgagggagtatatgttgctgcagtacgggaattttacttgtctgtttattttttcaaaaagaaaacaacatcaaggtttactttatcatcatcaagaaataagaagcatgctaaaaacaattttacgtgtgtagcatgtcacccaacggaagactgcatcgcatctggtcacatggatggcaaaattcgtctttggaggaatttttatgatgataagaaatatacgtacacatgtttacattggcaccatgatatggttatggatttggctttttcagtgacaggcaccagtctgctgagtggcggtcgtgaatctgtacttgtagagtggcgcgatgcaacagagaagaataaggagtttctcccgcgtttaggagctactattgaacatatctcagtctcgcctgcaggagatttattctgcacttctcactctgataataagataataattattcaccgaaaccttgaagcatccgcagtaattcaaggcctagtgaaagataggagtatcttcactggtttgatgattgatccaagaactaaagctttggttttgaatggaaaacctggccacctgcagttttattctctccagagtgataaacagttatacaatttagatattatacagcaagaatatattaatgattatggtctgatccaaattgaactaacaaaggctgcatttggctgctttggtaactggcttgcaacagtggaacagcggcaagaaaaggaaactgagcttgaattgcaaatgaaactgtggatgtataataagaaaacacaagggtttattcttaacactaaaattaacatgccacacgaagactgcattacagctctctgtttctgtaatgcagaaaaatctgaacagcccaccttggttacagctagcaaagatggttacttcaaagtatggatattaacagatgactctgacatatacaaaaaagctgttggctggacctgtgactttgttggtagttatcacaagtatcaagcaactaactgttgtttctccgaagatggttctttactagcagttagttttgaggaaatagtcacaatatgggattctgtaacatgggaacttaaatgtacattttgccaacgagctgggaaaataaggcacctttgctttgggagattgacgtgttcaaagtatctacttggtgctactgaaaatggcattctttgctgttggaatctgctgagctgtgcattggagtggaatgcaaaattaaatgttagagttatggaacccgatcctaattcagagaatattgctgcaatctctcagtcttcagtgggttcagacttgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttg

SEQ ID NO: 420248 - DNA, 2761 bp, Homo sapiens
acccggctcaacgaaggaagttcagggcgggaccagagattggccattccgctactgcgcaaagatggtggaggaggagaacatccgcgtggttcgttgtggcggcagcgagttgaactttaggagagctgtgttctctgcagattctaagtatatcttctgtgtctctggagactttgttaaagtttacagcacagttacagaagagtgtgtacacatactgcatggacacagaaatctggtgactggaatccagcttaaccccaacaaccatctacagctgtattcttgttcccttgatggcacaattaaactgtgggactatatagatggcatcttaataaagactttcatagttggatgtaaacttcatgccctctttactcttgcccaagctgaggattctgtctttgttatagtgaataaagaaaaaccagatatatttcagctggtttcagtgaaactgccaaaatcctcaagccaggaagtagaagccaaggagctgtcctttgttttggattacataaaccagtcacccaagtgcattgcctttggaaacgagggagtatatgttgctgcagtacgggaattttacttgtctgtttattttttcaaaaagaaaacaacatcaaggtttactttatcatcatcaagaaataagaagcatgctaaaaacaattttacgtgtgtagcatgtcacccaacggaagactgcatcgcatctggtcacatggatggcaaaattcgtctttggaggaatttttatgatgataagaaatatacgtacacatgtttacattggcaccatgatatggttatggatttggctttttcagtgacaggcaccagtctgctgagtggcggtcgtgaatctgtacttgtagagtggcgcgatgcaacagagaagaataaggagtttctcccgcgtttaggagctactattgaacatatctcagtctcgcctgcaggagatttattctgcacttctcactctgataataagataataattattcaccgaaaccttgaagcatccgcagtaattcaaggcctagtgaaagataggagtatcttcactggtttgatgattgatccaagaactaaagctttggttttgaatggaaaacctggccacctgcagttttattctctccagagtgataaacagttatacaatttagatattatacagcaagaatatattaatgattatggtctgatccaaattgaactaacaaaggctgcatttggctgctttggtaactggcttgcaacagtggaacagcggcaagaaaaggaaactgagcttgaattgcaaatgaaactgtggatgtataataagaaaacacaagggtttattcttaacactaaaattaacatgccacacgaagactgcattacagctctctgtttctgtaatgcagaaaaatctgaacagcccaccttggttacagctagcaaagatggttacttcaaagtatggatattaacagatgactctgacatatacaaaaaagctgttggctggacctgtgactttgttggtagttatcacaagtatcaagcaactaactgttgtttctccgaagatggttctttactagcagttagttttgaggaaatagtcacaatatgggattctgtaacatgggaacttaaatgtacattttgccaacgagctgggaaaataaggcacctttgctttgggagattgacgtgttcaaagtatctacttggtgctactgaaaatggcattctttgctgttggaatctgctgagctgtgcattggagtggaatgcaaaattaaatgttagagttatggaacccgatcctaattcagagaatattgctgcaatctctcagtcttcagtgggttcagacttgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttgaaaaaaaacacaaacaacaaccaaaacaaaccacaacaaacacaaaaccaaacaaacaaaaaaacacaaacaacacccaggg

SEQ ID NO: 420249 - DNA, 2670 bp, Homo sapiens
acccggctcaacgaaggaagttcagggcgggaccagagattggccattccgctactgcgcaaagatggtggaggaggagaacatccgcgtggttcgttgtggcggcagcgagttgaactttaggagagctgtgttctctgcagattctaagtatatcttctgtgtctctggagactttgttaaagtttacagcacagttacagaagagtgtgtacacatactgcatggacacagaaatctggtgactggaatccagcttaaccccaacaaccatctacagctgtattcttgttcccttgatggcacaattaaactgtgggactatatagatggcatcttaataaagactttcatagttggatgtaaacttcatgccctctttactcttgcccaagctgaggattctgtctttgttatagtgaataaagaaaaaccagatatatttcagctggtttcagtgaaactgccaaaatcctcaagccaggaagtagaagccaaggagctgtcctttgttttggattacataaaccagtcacccaagtgcattgcctttggaaacgagggagtatatgttgctgcagtacgggaattttacttgtctgtttattttttcaaaaagaaaacaacatcaaggtttactttatcatcatcaagaaataagaagcatgctaaaaacaattttacgtgtgtagcatgtcacccaacggaagactgcatcgcatctggtcacatggatggcaaaattcgtctttggaggaatttttatgatgataagaaatatacgtacacatgtttacattggcaccatgatatggttatggatttggctttttcagtgacaggcaccagtctgctgagtggcggtcgtgaatctgtacttgtagagtggcgcgatgcaacagagaagaataaggagtttctcccgcgtttaggagctactattgaacatatctcagtctcgcctgcaggagatttattctgcacttctcactctgataataagataataattattcaccgaaaccttgaagcatccgcagtaattcaaggcctagtgaaagataggagtatcttcactggtttgatgattgatccaagaactaaagctttggttttgaatggaaaacctggccacctgcagttttattctctccagagtgataaacagttatacaatttagatattatacagcaagaatatattaatgattatggtctgatccaaattgaactaacaaaggctgcatttggctgctttggtaactggcttgcaacagtggaacagcggcaagaaaaggaaactgagcttgaattgcaaatgaaactgtggatgtataataagaaaacacaagggtttattcttaacactaaaattaacatgccacacgaagactgcattacagctctctgtttctgtaatgcagaaaaatctgaacagcccaccttggttacagctagcaaagatggttacttcaaagtatggatattaacagatgactctgacatatacaaaaaagctgttggctggacctgtgactttgttggtagttatcacaagtatcaagcaactaactgttgtttctccgaagatggttctttactagcagttagttttgaggaaatagtcacaatatgggattctgtaacatgggaacttaaatgtacattttgccaacgagctgggaaaataaggcacctttgctttgggagattgacgtgttcaaagtatctacttggtgctactgaaaatggcattctttgctgttggaatctgctgagctgtgcattggagtggaatgcaaaattaaatgttagagttatggaacccgatcctaattcagagaatattgctgcaatctctcagtcttcagtgggttcagacttgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggcttggactttgtgtttttgattgtatgttgatattctaaaaacatctattttaatgttatttctgttctaaaaataagataataaatattaacaaactttgcttttttaaaaaactgataaaaaaaaaatgtatttgcatcatgct

SEQ ID NO: 420250 - DNA, 2822 bp, Homo sapiens
  misc_feature (1)..(5): n is a, c, g, or t
nnnnnttataaaatgcatagggctgggcgtggtggctcacaactgtaatcccaaagtgctgagattacaggtggcagccactgcaccttggtgcttttcatatctcattcaaaaccttaccatctccctcttcaagacagaaagttggcttttttcctctctcttttagttaaaacttgaaatggatggatctgcttcttgcagaaagctgtgaaaagattgttttgcagaagcaatataaataaatgactctacctctttaaggttaacagtgaattaatgaatagaaaatgcccctgatcaacatttaattattcatttgatatcttgatgaatttcttttttttaaatcaattttgtattgttttacccttttagctgtattcttgttcccttgatggcacaattaaactgtgggactatatagatggcatcttaataaagactttcatagttggatgtaaacttcatgccctctttactcttgcccaagctgaggattctgtctttgttatagtgaataaagaaaaaccagatatatttcagctggtttcagtgaaactgccaaaatcctcaagccaggaagtagaagccaaggagctgtcctttgttttggattacataaaccagtcacccaagtgcattgcctttggaaacgagggagtatatgttgctgcagtacgggaattttacttgtctgtttattttttcaaaaagaaaacaacatcaaggtttactttatcatcatcaagaaataagaagcatgctaaaaacaattttacgtgtgtagcatgtcacccaacggaagactgcatcgcatctggtcacatggatggcaaaattcgtctttggaggaatttttatgatgataagaaatatacgtacacatgtttacattggcaccatgatatggttatggatttggctttttcagtgacaggcaccagtctgctgagtggcggtcgtgaatctgtacttgtagagtggcgcgatgcaacagagaagaataaggagtttctcccgcgtttaggagctactattgaacatatctcagtctcgcctgcaggagatttattctgcacttctcactctgataataagataataattattcaccgaaaccttgaagcatccgcagtaattcaaggcctagtgaaagataggagtatcttcactggtttgatgattgatccaagaactaaagctttggttttgaatggaaaacctggccacctgcagttttattctctccagagtgataaacagttatacaatttagatattatacagcaagaatatattaatgattatggtctgatccaaattgaactaacaaaggctgcatttggctgctttggtaactggcttgcaacagtggaacagcggcaagaaaaggaaactgagcttgaattgcaaatgaaactgtggatgtataataagaaaacacaagggtttattcttaacactaaaattaacatgccacacgaagactgcattacagctctctgtttctgtaatgcagaaaaatctgaacagcccaccttggttacagctagcaaagatggttacttcaaagtatggatattaacagatgactctgacatatacaaaaaagctgttggctggacctgtgactttgttggtagttatcacaagtatcaagcaactaactgttgtttctccgaagatggttctttactagcagttagttttgaggaaatagtcacaatatgggattctgtaacatgggaacttaaatgtacattttgccaacgagctgggaaaataaggcacctttgctttgggagattgacgtgttcaaagtatctacttggtgctactgaaaatggcattctttgctgttggaatctgctgagctgtgcattggagtggaatgcaaaattaaatgttagagttatggaacccgatcctaattcagagaatattgctgcaatctctcagtcttcagtgggttcagacttgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttgcttttttaaaaaactgataaaaaaaaaatgtatttgcatcatgct

SEQ ID NO: 420251 - DNA, 2548 bp, Homo sapiens
acccggctcaacgaaggaagttcagggcgggaccagagattggccattccgctactgcgcaaagatggtggaggaggagaacatccgcgtggttcgttgtggcggcagcgagttgaactttaggagagctgtgttctctgcagattctaagtatatcttctgtgtctctggagactttgttaaagtttacagcacagttacagaagagtgtgtacacatactgcatggacacagaaatctggtgactggaatccagcttaaccccaacaaccatctacagctgtattcttgttcccttgatggcacaattaaactgtgggactatatagatggcatcttaataaagactttcatagttggatgtaaacttcatgccctctttactcttgcccaagctgaggattctgtctttgttatagtgaataaagaaaaaccagatatatttcagctggtttcagtgaaactgccaaaatcctcaagccaggaagtagaagccaaggagctgtcctttgttttggattacataaaccagtcacccaagtgcattgcctttggaaacgagggagtatatgttgctgcagtacgggaattttacttgtctgtttattttttcaaaaagaaaacaacatcaaggtttactttatcatcatcaagaaataagaagcatgctaaaaacaattttacgtgtgtagcatgtcacccaacggaagactgcatcgcatctggtcacatggatggcaaaattcgtctttggaggaatttttatgatgataagaaatatacgtacacatgtttacattggcaccatgatatggttatggatttggctttttcagtgacaggcaccagtctgctgagtggcggtcgtgaatctgtacttgtagagtggcgcgatgcaacagagaagaataaggagtttctcccgcgtttaggagctactattgaacatatctcagtctcgcctgcaggagatttattctgcacttctcactctgataataagataataattattcaccgaaaccttgaagcatccgcagtaattcaaggcctagtgaaagataggagtatcttcactggtttgatgattgatccaagaactaaagctttggttttgaatggaaaacctggccacctgcagttttattctctccagagtgataaacagttatacaatgtttattcttaacactaaaattaacatgccacacgaagactgcattacagctctctgtttctgtaatgcagaaaaatctgaacagcccaccttggttacagctagcaaagatggttacttcaaagtatggatattaacagatgactctgacatatacaaaaaagctgttggctggacctgtgactttgttggtagttatcacaagtatcaagcaactaactgttgtttctccgaagatggttctttactagcagttagttttgaggaaatagtcacaatatgggattctgtaacatgggaacttaaatgtacattttgccaacgagctgggaaaataaggcacctttgctttgggagattgacgtgttcaaagtatctacttggtgctactgaaaatggcattctttgctgttggaatctgctgagctgtgcattggagtggaatgcaaaattaaatgttagagttatggaacccgatcctaattcagagaatattgctgcaatctctcagtcttcagtgggttcagacttgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttgcttttttaaaaaactgataaaaaaaaaatgtatttgcatcatgct

SEQ ID NO: 420252 - DNA, 2275 bp, Homo sapiens
atgtcctgccatctgctgctttcctgtgctccatgtttgtaaattcattgctgctgtcctttgttttggattacataaaccagtcacccaagtgcattgcctttggaaacgagggagtatatgttgctgcagtacgggaattttacttgtctgtttattttttcaaaaagaaaacaacatcaaggtttactttatcatcatcaagaaataagaagcatgctaaaaacaattttacgtgtgtagcatgtcacccaacggaagactgcatcgcatctggtcacatggatggcaaaattcgtctttggaggaatttttatgatgataagaaatatacgtacacatgtttacattggcaccatgatatggttatggatttggctttttcagtgacaggcaccagtctgctgagtggcggtcgtgaatctgtacttgtagagtggcgcgatgcaacagagaagaataaggagtttctcccgcgtttaggagctactattgaacatatctcagtctcgcctgcaggagatttattctgcacttctcactctgataataagataataattattcaccgaaaccttgaagcatccgcagtaattcaaggcctagtgaaagataggagtatcttcactggtttgatgattgatccaagaactaaagctttggttttgaatggaaaacctggccacctgcagttttattctctccagagtgataaacagttatacaatttagatattatacagcaagaatatattaatgattatggtctgatccaaattgaactaacaaaggctgcatttggctgctttggtaactggcttgcaacagtggaacagcggcaagaaaaggaaactgagcttgaattgcaaatgaaactgtggatgtataataagaaaacacaagggtttattcttaacactaaaattaacatgccacacgaagactgcattacagctctctgtttctgtaatgcagaaaaatctgaacagcccaccttggttacagctagcaaagatggttacttcaaagtatggatattaacagatgactctgacatatacaaaaaagctgttggctggacctgtgactttgttggtagttatcacaagtatcaagcaactaactgttgtttctccgaagatggttctttactagcagttagttttgaggaaatagtcacaatatgggattctgtaacatgggaacttaaatgtacattttgccaacgagctgggaaaataaggcacctttgctttgggagattgacgtgttcaaagtatctacttggtgctactgaaaatggcattctttgctgttggaatctgctgagctgtgcattggagtggaatgcaaaattaaatgttagagttatggaacccgatcctaattcagagaatattgctgcaatctctcagtcttcagtgggttcagacttgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttgcttttttaaaaaactgataaaaaaaaaatgtatttgcatcatgct

SEQ ID NO: 420253 - DNA, 3128 bp, Homo sapiens
acccggctcaacgaaggaagttcagggcgggaccagagattggccattccgctactgcgcaaagatggtggaggaggagaacatccgcgtggttcgttgtggcggcagcgagttgaactttaggagagctgtgttctctgcagattctaagtatatcttctgtgtctctggagactttgttaaagtttacagcacagttacagaagagtgtgtacacatactgcatggacacagaaatctggtgactggaatccagcttaaccccaacaaccatctacagctgtattcttgttcccttgatggcacaattaaactgtgggactatatagatggcatcttaataaagactttcatagttggatgtaaacttcatgccctctttactcttgcccaagctgaggattctgtctttgttatagtgaataaagaaaaaccagatatatttcagctggtttcagtgaaactgccaaaatcctcaagccaggaagtagaagccaaggagctgtcctttgttttggattacataaaccagtcacccaagtgcattgcctttggaaacgagggagtatatgttgctgcagtacgggaattttacttgtctgtttattttttcaaaaagaaaacaacatcaaggtttactttatcatcatcaagaaataagaagcatgctaaaaacaattttacgtgtgtagcatgtcacccaacggaagactgcatcgcatctggtcacatggatggcaaaattcgtctttggaggaatttttatgatgataagaaatatacgtacacatgtttacattggcaccatgatatggttatggatttggctttttcagtgacaggcaccagtctgctgagtggcggtcgtgaatctgtacttgtagagtggcgcgatgcaacagagaagaataaggagtttctcccgcgtttaggagctactattgaacatatctcagtctcgcctgcaggagatttattctgcacttctcactctgataataagataataattattcaccgaaaccttgaagcatccgcagtaattcaaggcctagtgaaagataggagtatcttcactggtttgatgattgatccaagaactaaagctttggttttgaatggaaaacctggccacctgcagttttattctctccagagtgataaacagttatacaatttagatattatacagcaagaatatattaatgattatggtctgatccaaattgaactaacaaaggctgcatttggctgctttggtaactggcttgcaacagtggaacagcggcaagaaaaggaaactgagcttgaattgcaaatgaaactgtggatgtataataagaaaacacaagggtttattcttaacactaaaattaacatgccacacgaagactgcattacagctctctgtttctgtaatgcagaaaaatctgaacagcccaccttggttacagctagcaaagatggttacttcaaagtatggatattaacagatgactctgacatatacaaaaaagctgttggctggacctgtgactttgttggtagttatcacaagtatcaagcaactaactgttgtttctccgaagatggttctttactagcagttagttttgaggaaatagtcacaatatgggattctgtaacatgggaacttaaatgtacattttgccaacgagctgggaaaataaggcacctttgctttgggagattgacgtgttcaaagtatctacttggtgctactgaaaatggcattctttgctgttggaatctgctgagctgtgcattggagtggaatgcaaaattaaatgttagagttatggaacccgatcctaattcagagaatattgctgcaatctctcagtcttcagtgggttcagacttgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagaggtaaagcagttcttaagacaggtttggacactctcttttgggaaacaggatcgtttgtgtttatccttttttagagtattcttccactgtatttctttttatttcataagttttaaaatagatttaaaggctataggattattaagtcaagtaacatacattgaaaataagtttcaaaaaagatcttgtatgtgtgtgttttaagggcttggtacataatttaaaattacatgtttgtaaattcacctgctcttttataaataacccataatttttaaagtgtacttagtaacaaaattcttcatttactttgtgtgattatatttctacataggtgtcaaattagaaagttactgtttagaaacatttaatagtgtttatattttattctgttattgttaaagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttgcttttttaaaaaactgataaaaaaaaaatgtatttgcatcatgct

SEQ ID NO: 420254 - DNA, 1016 bp, Homo sapiens
gcctggcccatagtaggaacacagtagatacctcttgaatcaaagcctaaaacagtcatgacttgggccagttactcaatggggtgagtcccaggattagtgtgatctgccagtctgaggctagaactaaccttttcaggcaaaatgttattgtttctttgttttttccctctagtgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttgcttttttaaaaaactgataaaaaaaaaatgtatttgcatcatgct

SEQ ID NO: 420255 - DNA, 878 bp, Homo sapiens
taccatttcttaagtatctctcagacataatcttgtaactctcatcgtggttattaaataggtttaaatcttttattccttttctgttgtcaaatatatatatcaaagtgaaaaatttgaccttctcattttttaacaccctgtaacaccttgtttagatttgcactctacagtttgtcttttgcatcattaattctctcttttcagagtttattgacattcagtacaaagtctccagaagaaaaactcacaccaacaagcaaacagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttgcttttttaaaaaactgataaaaaaaaaatgtatttgcatcatgct

SEQ ID NO: 420256 - DNA, 1061 bp, Homo sapiens
ggggtggttgttggcataaatgtaggaaggtagaaatgtatttttctttggtttggcttttgtatagggaaagccttttcatgtttcactcttggcatttacaataaaagggactccgtgaggacactgtaggaacagactgcggtggaggataagctttttaattgcaaccgtgttttctgtttgactccagcttcttcacactccagcccatgtcctgccatctgctgctttcctgtgctccatgtttgtaaattcattgctgctgtctaaagagactaagaggtaaagcagttcttaagacaggtttggacactctcttttgggaaacaggatcgtttgtgtttatccttttttagagtattcttccactgtatttctttttatttcataagttttaaaatagatttaaaggctataggattattaagtcaagtaacatacattgaaaataagtttcaaaaaagatcttgtatgtgtgtgttttaagggcttggtacataatttaaaattacatgtttgtaaattcacctgctcttttataaataacccataatttttaaagtgtacttagtaacaaaattcttcatttactttgtgtgattatatttctacataggtgtcaaattagaaagttactgtttagaaacatttaatagtgtttatattttattctgttattgttaaagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttgcttttttaaaaaactgataaaaaaaaaatgtatttgcatcatgct

SEQ ID NO: 420257 - DNA, 964 bp, Homo sapiens
  misc_feature (1)..(5): n is a, c, g, or t
nnnnnttataaaatgcatagggctgggcgtggtggctcacaactgtaatcccaaagtgctgagattacaggtggcagccactgcaccttggtgcttttcatatctcattcaaaaccttaccatctccctcttcaagacagaaagttggcttttttcctctctcttttagttaaaacttgaaatggatggatctgcttcttgcagaaagctgtgaaaagattgttttgcagaagcaatataaataaatgactctacctctttaaggttaacagtgaattaatgaatagaaaatgcccctgatcaacatttaattattcatttgatatcttgatgaatttcttttttttaaatcaattttgtattgttttacccttttagctgtattcttgttcccttgatggcacaattaaactgtgggactatatagatggcatcttaataaagactttcatagttggatgtaaacttcatgccctctttactcttgcccaagctgaggattctgtctttgttatagtgaataaagaaaaaccagatatatttcagctggtttcagtgaaactgccaaaatcctcaagccaggaagtagaagccaaggagctgtcctttgttttggattacataaaccagtcacccaagtgcattgcctttggaaacgaggtaaattttgttttgttcgttttctgttttgtacctaaaatttctttcctgcaatctctcttctgagcattttatgttacagtgattttatattcccttgaattactatatttgtattagtaactaagaagcctcttcattgctttagcatgtatttatggtatagatttttttaggactatccttatttttgtgtgttctgtcctattgcctttgtaaactctcttagactatgtgtctttagaaattatggcctcccatatgttaattaattaatgtttataattaatatgcccattataga

SEQ ID NO: 420258 - DNA, 866 bp, Homo sapiens
acccggctcaacgaaggaagttcagggcgggaccagagattggccattccgctactgcgcaaagatggtggaggaggagaacatccgcgtggttcgttgtggcggcagcgagttgaactttaggagagctgtgttctctgcagattctaagtatatcttctgtgtctctggagactttgttaaagtttacagcacagttacagaagagtgtgtacacatactgcatggacacagaaatctggtgactggaatccagcttaaccccaacaaccatctacagctgtattcttgttcccttgatggcacaattaaactgtgggactatatagatggcatcttaataaagactttcatagttggatgtaaacttcatgccctctttactcttgcccaagctgaggattctgtctttgttatagtgaataaagaaaaaccagatatatttcagctggtttcagtgaaactgccaaaatcctcaagccaggaagtagaagccaaggagctgtcctttgttttggattacataaaccagtcacccaagtgcattgcctttggaaacgaggtaaattttgttttgttcgttttctgttttgtacctaaaatttctttcctgcaatctctcttctgagcattttatgttacagtgattttatattcccttgaattactatatttgtattagtaactaagaagcctcttcattgctttagcatgtatttatggtatagatttttttaggactatccttatttttgtgtgttctgtcctattgcctttgtaaactctcttagactatgtgtctttagaaattatggcctcccatatgttaattaattaatgtttataattaatatgcccattataga

SEQ ID NO: 420259 - DNA, 621 bp, Homo sapiens
tactactaaattcgcggccgcgtcgacgctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420260 - DNA, 2235 bp, Homo sapiens
atatcgtggttgtgtcgtgagaactttaagattttgcagttccttgtaggcaggagtcctgtttgctgctactttacaatactaggcttaagacattttatgaaatgaactcacacaacagtctctgagaggctcaagcccctccttcccttccgggacggaggatcatagagctgtctggcgcagcgaggcctcccggcgccaccgagacgcgcagaggacggctagagcgttgctcgccgagagacttcctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggacggaatttcgctctgtcgcccaggctggagcgcaatggtgagatcttggcttactgcaacctccgcctcccgagttcaagagattcttctgcctcagtctcccgagtagctgggactttaggtacgcgccaccacgaccggctaatttttgtattaatagtggagttgggggtttcaccatgttggccaggctagtctcgaactcctgacctcgtgatccgcctgcctcggcctcccaaagtgctaggattacattacaggcgtgagccactgcccccggccaagaatactcttattacacactttgtagctcttttatctgacttcacaccaacatccagctaatgtcttgtgaacaccaaggagtatgtatagttgagatgtaatatttccctttgctgtttgagaacattaatatggagataaagctggtggtttacactttgctaatatcttagaagatacaggcaatagacaaaaataggaggatatagaaacagggagcttggctctgttaatcttcaacttcagcttaattgtggctcatttctaaactgtcactaagaaacctggattgtgttcacttgttcagtgttttatttgaatgagcaagttatggcagtagggcatctttaatctgtagtctcagaactgacaggctaaaaggaacacaggaatagtagtgtgtagtagggaatggtttaaaaaaaaaaattagccaggcacagtggttcacgcctgtaatcccagcactttgggaggccaaggctggcagatcacctgaggtcaggagttagagatcggtctggccaacatggtgaaaccccgtctttactaaatatacaaaaattagccaggcgtggtggcacatgcttgtaatcccagctactccggcgactgagacaggagaattgctttaacccgagaggcagaggttgcagtgagccgatagcgggcaattgcactccaacctgggcgatagagcgagactctgtctcagaaagcaaaaaacaaacaaaacattgactttgtcaggaattagctacttcatgattgagggcattaagggaaatgaggctggctttttacttgtagtactctacaacagtaggaaaacattatgtctagtctttctggaggggctaatgggaagaattgcaagaactgcttagagagtgagagatgggatgaggcaggacaagagggtgttccagcatacatcattttctccttaaagaaccaacttctctgtcttctttccatttggagttataggtattgttctaaggcctccagattattcagtccttatgccttgtagctttttggaaaaagagggtctttggaggccaagcaggctggctggcggaatcatggctcatgctgggctggctagtttttcccttaattcttgcttctcagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420261 - DNA, 230 bp, Homo sapiens
gcggccgactactactactactgctcgaattcaagcttctaacgatgtacggggacatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420262 - DNA, 844 bp, Homo sapiens
atatcgtggttgtgtcgtgagaactttaagattttgcagttccttgtaggcaggagtcctgtttgctgctactttacaatactaggcttaagacattttatgaaatgaactcacacaacagtctctgagaggctcaagcccctccttcccttccgggacggaggatcatagagctgtctggcgcagcgaggcctcccggcgccaccgagacgcgcagaggacggctagagcgttgctcgccgagagacttcctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420263 - DNA, 603 bp, Homo sapiens
aggctagtagaggcgggtgtgaatcggccgaggcacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420264 - DNA, 487 bp, Homo sapiens
ccctattttccttctttattgcaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaggaataaggtaccgctta

SEQ ID NO: 420265 - DNA, 256 bp, Homo sapiens
ctctagacatcccgtcacggtagatttagatggagaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420266 - DNA, 801 bp, Homo sapiens
  misc_feature (653)..(653): n is a, c, g, or t
  misc_feature (659)..(659): n is a, c, g, or t
  misc_feature (688)..(688): n is a, c, g, or t
  misc_feature (693)..(693): n is a, c, g, or t
  misc_feature (698)..(698): n is a, c, g, or t
  misc_feature (703)..(703): n is a, c, g, or t
  misc_feature (705)..(705): n is a, c, g, or t
  misc_feature (707)..(708): n is a, c, g, or t
  misc_feature (710)..(712): n is a, c, g, or t
  misc_feature (714)..(714): n is a, c, g, or t
  misc_feature (717)..(718): n is a, c, g, or t
  misc_feature (743)..(743): n is a, c, g, or t
  misc_feature (750)..(750): n is a, c, g, or t
tactactaaattcgcggccgcgtcgacgctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaaaaatcngggggntttttgggggggggggaaaaaggggtttntaaangggcnggggncntnntnnntncgnncccttttttgtacaaggggggaatnggggggncccaaaaagggggggggaataattggaaagacgggtaccgtaattgaaaac

SEQ ID NO: 420267 - DNA, 1031 bp, Homo sapiens
tactactaaattcgcggccgcgtcgacgctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaaaaaaaaaaaaaaaaaaaaaaaaaaaaaaaaaaaaaaaaaagcgggggttttttttgggggggggaaaaaaagggtaaaagagggctgtgaatattgggaacccacttctttgacagaggagaaaaggcggggacccccaaagagagggggttaaaacacaagcggggtcatcggtaatgagcgccgcgcagaaaggcaggaaccagcaagaggaaggagcgacgagacgcaaagacgaggcgaaaacacagagcgagaagacgaaggctacgaaaacgaacaacaaacagcaggaaaagaaaaggaggaccaagcacagcagcagagaaacgcaggagagaagacacacgcacagagcaacaaagaagagagagacgagcacag

SEQ ID NO: 420268 - DNA, 893 bp, Homo sapiens
tactactaaattcgcggccgcgtcgacgctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaactggagactagttctctctctccgtgactccagtcagtggtcctggtcccactgtcccagtgtaggttagtattccttcacatcctgtccatggcttaagaatgtcccacttcctaacgtgactccaaactgcatctctacatttaggaacagagacccgccttaagagactggatcgcacacctttgcaacagatgtgttctgattctctgaacctactagttatacatagtggaatgaaggtcc

SEQ ID NO: 420269 - DNA, 1277 bp, Homo sapiens
tactactaaattcgcggccgcgtcgacgctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaaaaaaaaaaaaaaaaaaaaaaaaaaaaaaaaaaaaaaaaaaagggggcgggcctctactaaatatattatctctcctcgaggggggcgccatatgtgtactgctactcccggtttttttgttgcaacagagggggcccctactatgaggagggtgtatatttaacaacccggtagcgcactgcggcgcggtgtttttaaaacgacgcgtcgtgagtggggaacaaacatgtgtgattcccggtgaggagatctctctttgagggaggacaaagagcacaacgctatatatgactcgggggggggggggggaaaacaactaatggtgtgtgggaacaaaaaaacttatcacgatcagaaaagaatagatatatatatataaaggcagttctttatggagggaggggaaactatttatttaaatacattgttttagaaagggatggtggtcttatcaaatggtgtgtgtgtcaaacaaaaccataggcgagtgtaatatattatcgtcgagtggggagtgtgagttagagagaaagacgtttttgtcggtaacctaaaggaggagggtaatttatatgtcttattttgatgtagaaagactatctttttatttaatatcaacagaggaaggta

SEQ ID NO: 420270 - DNA, 1325 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcaaaaaaaaaaaaaaaaaaaaaaaaaaaaaaaaaaaaaaaaaaaaaaacctccgagagggtctcttttgtcgcgggtgtgcgcggaaaaagagagaggttagagtgaaaagtggcacacctgtgtggctcaatatgaggcggtgtttctccggtagccccacaggcttctttgtgtgttcaacaaagtgtggcgtaaaaatttgcgcggggtatctcccccttattagaggaggggcgcggttattataatttgcgaaattaggccccgggtgttttacccgtgtgatattaaaggaa

SEQ ID NO: 420271 - DNA, 1000 bp, Homo sapiens
  misc_feature (12)..(12): n is a, c, g, or t
  misc_feature (27)..(27): n is a, c, g, or t
  misc_feature (37)..(37): n is a, c, g, or t
  misc_feature (50)..(50): n is a, c, g, or t
ttgatttgactncctttgtgaagtccnactctatttnggctaaacttccngcggatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaaaaaaaaaaaaaaaaaaaaaaaaaaaaaaaaaaaaaaaaaagcgggggttttttttgggggggggaaaaaaagggtaaaagagggctgtgaatattgggaacccacttctttgacagaggagaaaaggcggggacccccaaagagagggggttaaaacacaagcggggtcatcggtaatgagcgccgcgcagaaaggcaggaaccagcaagaggaaggagcgacgagacgcaaagacgaggcgaaaacacagagcgagaagacgaaggctacgaaaacgaacaacaaacagcaggaaaagaaaaggaggaccaagcacagcagcagagaaacgcaggagagaagacacacgcacagagcaacaaagaagagagagacgagcacag

SEQ ID NO: 420272 - DNA, 713 bp, Homo sapiens
tactactaaattcgcggccgcgtcgacgctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcataaaatccaataaagaaaatcaagggggccggttccaatttgccataggaggcgataaaattacatggcgtttactcttttgcctgggttcc

SEQ ID NO: 420273 - DNA, 659 bp, Homo sapiens
tactactaaattcgcggccgcgtcgacgctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcatgggccaattggccttttaggggaggggtttataaatt

SEQ ID NO: 420274 - DNA, 592 bp, Homo sapiens
tactactaaattcgcggccgcgtcgacgctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacacccttttacgtgcttcctgtgttggtaccgtcgatcaggatcc

SEQ ID NO: 420275 - DNA, 959 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgaacgtgttccgagtcatggcatggaccgagcta

SEQ ID NO: 420276 - DNA, 1603 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgagggtatggggtaggcgggtgagggtaacctaaagtggcgaacctgcttctctcgtcccacctcctaacccagtttttcttacctgaaacgagaaaatccattacatatcgtataccgcttcatgaaccctttgcatgttgcctgcctagaattgaaaagtacaggacattcctctgctcctattgcccctgtttccgttcttttcacactgtctgtgggtgctgtgccctgttggaactctctttaacgtcttacgttggagccgctaaccttccccaggtgtttgtcttcattgctttcacagggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaactggagactagttctctctctccgtgactccagtcagtggtcctggtcccactgtcccagtgtaggttagtattccttcacatcctgtccatggcttaagaatgtcccacttcctaacgtgactccaaactgcatctctacatttaggaacagagacccgccttaagagactggatcgcacacctttgcaacagatgtgttctgattctctgaacctactagttatacatagtggaatgaaggtcc

SEQ ID NO: 420277 - DNA, 1331 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgagggtatggggtaggcgggtgagggtaacctaaagtggcgaacctgcttctctcgtcccacctcctaacccagtttttcttacctgaaacgagaaaatccattacatatcgtataccgcttcatgaaccctttgcatgttgcctgcctagaattgaaaagtacaggacattcctctgctcctattgcccctgtttccgttcttttcacactgtctgtgggtgctgtgccctgttggaactctctttaacgtcttacgttggagccgctaaccttccccaggtgtttgtcttcattgctttcacagggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420278 - DNA, 1198 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccagggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaactggagactagttctctctctccgtgactccagtcagtggtcctggtcccactgtcccagtgtaggttagtattccttcacatcctgtccatggcttaagaatgtcccacttcctaacgtgactccaaactgcatctctacatttaggaacagagacccgccttaagagactggatcgcacacctttgcaacagatgtgttctgattctctgaacctactagttatacatagtggaatgaaggtcc

SEQ ID NO: 420279 - DNA, 997 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca
